United States Patent
Champion et al.

(10) Patent No.: US 11,840,702 B2
(45) Date of Patent: Dec. 12, 2023

(54) ADENOVIRUS ARMED WITH BISPECIFIC T CELL ACTIVATOR

(71) Applicant: AKAMIS BIO LIMITED, Oxfordshire (GB)

(72) Inventors: Brian Champion, Oxfordshire (GB); Alice Claire Noel Bromley, Oxfordshire (GB)

(73) Assignee: AKAMIS BIO LIMITED, Oxfordshire (GB)

( * ) Notice: Subject to any disclaimer, the term of this patent is extended or adjusted under 35 U.S.C. 154(b) by 646 days.

(21) Appl. No.: 16/641,696

(22) PCT Filed: Aug. 28, 2018

(86) PCT No.: PCT/EP2018/073160
§ 371 (c)(1),
(2) Date: Feb. 25, 2020

(87) PCT Pub. No.: WO2019/043020
PCT Pub. Date: Mar. 7, 2019

(65) Prior Publication Data
US 2020/0216859 A1   Jul. 9, 2020

(30) Foreign Application Priority Data

Aug. 28, 2017 (GB) ..................... 1713765
Aug. 29, 2017 (WO) ............. PCT/EP2017/071655
Aug. 29, 2017 (WO) ............. PCT/EP2017/071674

(51) Int. Cl.
| | |
|---|---|
| *C12N 15/86* | (2006.01) |
| *A61P 35/00* | (2006.01) |
| *C07K 14/52* | (2006.01) |
| *C07K 14/715* | (2006.01) |
| *C07K 16/28* | (2006.01) |
| *C07K 16/30* | (2006.01) |
| *C07K 16/40* | (2006.01) |
| *A61K 39/00* | (2006.01) |

(52) U.S. Cl.
CPC ............. *C12N 15/86* (2013.01); *A61P 35/00* (2018.01); *C07K 14/522* (2013.01); *C07K 14/7156* (2013.01); *C07K 16/2809* (2013.01); *C07K 16/30* (2013.01); *C07K 16/40* (2013.01); *A61K 2039/505* (2013.01); *C07K 2317/31* (2013.01); *C07K 2317/56* (2013.01); *C07K 2317/622* (2013.01); *C07K 2317/73* (2013.01); *C07K 2317/75* (2013.01); *C07K 2319/92* (2013.01); *C12N 2710/10332* (2013.01); *C12N 2710/10343* (2013.01); *C12N 2830/60* (2013.01); *C12N 2840/44* (2013.01)

(58) Field of Classification Search
CPC .................. C12N 15/86; C07K 14/522; C07K 16/2809; C07K 14/7158
See application file for complete search history.

(56) References Cited

U.S. PATENT DOCUMENTS

| | | | |
|---|---|---|---|
| 5,358,866 A | | 10/1994 | Mullen et al. |
| 5,595,756 A | * | 1/1997 | Bally ................. A61K 9/1272 264/4.1 |
| 5,631,236 A | | 5/1997 | Woo et al. |
| 5,648,478 A | | 7/1997 | Henderson |
| 5,677,178 A | | 10/1997 | McCormick |
| 5,843,772 A | | 12/1998 | Devine et al. |
| 5,972,706 A | | 10/1999 | McCormick |
| 6,291,214 B1 | | 9/2001 | Richards et al. |
| 6,294,377 B1 | | 9/2001 | Haddada et al. |
| 6,420,524 B1 | | 7/2002 | Craig |
| 7,264,958 B1 | | 9/2007 | Koehl et al. |
| 7,288,251 B2 | | 10/2007 | Bedian et al. |
| 7,459,153 B2 | | 12/2008 | Wadell et al. |
| 7,550,296 B2 | | 6/2009 | Hermiston |
| 7,858,367 B2 | | 12/2010 | Amalfitano et al. |
| 8,052,965 B2 | | 8/2011 | Van Beusechem et al. |
| 8,216,819 B2 | | 7/2012 | Hermiston |
| 2002/0019051 A1 | | 2/2002 | Lusky |
| 2002/0061592 A1 | | 5/2002 | Blanche et al. |
| 2003/0017138 A1 | | 1/2003 | Havenga et al. |
| 2003/0044384 A1 | | 3/2003 | Roberts |
| 2003/0096787 A1 | | 5/2003 | Perricaudet et al. |

(Continued)

FOREIGN PATENT DOCUMENTS

| | | |
|---|---|---|
| AU | 2010244348 A1 | 11/2010 |
| CN | 1241632 A | 1/2000 |

(Continued)

OTHER PUBLICATIONS

Heppner et al. Cancer Metastasis Review 2:5-23; 1983 (Year: 1983).*
Alemany. Biomedicines, 2014, 2, 36-49 (Year: 2014).*
Fajardo et al. Cancer Res., 77(8):2052-63, 2017 (Year: 2017).*
Sporn et al. Chemoprevention of Cancer, Carcinogenesis, vol. 21 (2000), 525-530 (Year: 2000).*
Auerbach et al. Cancer and Metastasis Reviews, 2000, 19: 167-172 (Year: 2000).*
Gura T. Science, 1997, 278(5340): 1041-1042 (Year: 1997).*
Jain RK. Scientific American, Jul. 1994,58-65 (Year: 1994).*
Hait. Nature Reviews/Drug Discovery, 2010, 9, pp. 253-254 (Year: 2010).*

(Continued)

*Primary Examiner* — Vanessa L. Ford
*Assistant Examiner* — Sandra Dillahunt
(74) *Attorney, Agent, or Firm* — Dechert LLP; Andrew T. Wilkins; David M. Lee

(57) ABSTRACT

An adenovirus comprising a sequence of formula (I) 5'ITR-$B_1$-$B_A$-$B_2$-$B_X$-$B_B$-$B_Y$-$B_3$-3'ITR wherein $B_Y$ comprises a transgene cassette containing four transgenes, said genes encoding a FAP-Bispecific T cell activator, CXL10, CXL9, and IFN. The disclosure also extends to a pharmaceutical composition comprising the virus, and use of the virus or formulation in treatment.

9 Claims, 74 Drawing Sheets

Specification includes a Sequence Listing.

(56) References Cited

U.S. PATENT DOCUMENTS

| | | |
|---|---|---|
| 2004/0136958 A1 | 7/2004 | Wadell et al. |
| 2004/0151696 A1 | 8/2004 | Johnson et al. |
| 2004/0213764 A1 | 10/2004 | Wold et al. |
| 2005/0175589 A1 | 8/2005 | Iggo et al. |
| 2005/0186225 A1 | 8/2005 | Evans et al. |
| 2006/0140909 A1 | 6/2006 | Wickham et al. |
| 2006/0292682 A1 | 12/2006 | Hawkins et al. |
| 2008/0069836 A1 | 3/2008 | Nabel et al. |
| 2008/0292592 A1 | 11/2008 | Ch et al. |
| 2009/0022738 A1 | 1/2009 | Hofmeister et al. |
| 2009/0311219 A1 | 12/2009 | Bonastre et al. |
| 2010/0297072 A1 | 11/2010 | Depinho |
| 2011/0034560 A1 | 2/2011 | Jacobson et al. |
| 2012/0034228 A1 | 2/2012 | Kufer et al. |
| 2012/0283318 A1 | 11/2012 | Mei et al. |
| 2013/0243731 A1 | 9/2013 | Dias et al. |
| 2017/0266243 A1 | 9/2017 | Champion et al. |
| 2018/0140649 A1 | 5/2018 | Champion et al. |
| 2018/0311291 A1 | 11/2018 | Champion et al. |
| 2019/0076493 A1 | 3/2019 | Champion et al. |
| 2019/0194690 A1 | 6/2019 | Champion et al. |
| 2019/0233536 A1 | 8/2019 | Champion et al. |

FOREIGN PATENT DOCUMENTS

| | | |
|---|---|---|
| CN | 1242051 A | 1/2000 |
| CN | 101381742 A | 3/2009 |
| CN | 102586327 A | 7/2012 |
| DE | 102005055128 A1 | 5/2007 |
| EP | 1054064 A1 | 11/2000 |
| EP | 170269 A2 | 5/2007 |
| JP | 2002531133 | 9/2002 |
| SE | 0100035-5 | 1/2001 |
| WO | 1998/022609 A1 | 5/1998 |
| WO | 1999/018799 A1 | 4/1999 |
| WO | 2000/15823 A1 | 3/2000 |
| WO | 00/32754 A1 | 6/2000 |
| WO | 00/34494 | 6/2000 |
| WO | 00/73478 A3 | 12/2000 |
| WO | 01/11034 A2 | 2/2001 |
| WO | 2001/53506 A2 | 7/2001 |
| WO | 2001/092549 A2 | 12/2001 |
| WO | 2001/094413 A2 | 12/2001 |
| WO | 2002/053759 A1 | 7/2002 |
| WO | 2002/099119 A2 | 12/2002 |
| WO | 2003/040170 A2 | 5/2003 |
| WO | 2003/064666 A1 | 8/2003 |
| WO | 2005/010149 A1 | 6/2004 |
| WO | 2004/108893 A2 | 12/2004 |
| WO | 2005/040220 A1 | 5/2005 |
| WO | 2005/086922 A2 | 9/2005 |
| WO | 2005/107474 A2 | 11/2005 |
| WO | 2005/118825 A2 | 12/2005 |
| WO | 2006/060314 A2 | 6/2006 |
| WO | 2007/027860 A1 | 3/2007 |
| WO | 2008/080003 | 7/2008 |
| WO | 2009/143610 A1 | 12/2009 |
| WO | 2010/037835 A2 | 4/2010 |
| WO | 2012/024351 A1 | 2/2012 |
| WO | 2013/026833 A1 | 2/2013 |
| WO | 2013/074507 A1 | 5/2013 |
| WO | 2013164754 A2 | 11/2013 |
| WO | 2014/138314 A1 | 9/2014 |
| WO | 2014138314 A1 | 9/2014 |
| WO | 2015/059303 A1 | 4/2015 |
| WO | 2015/059456 A1 | 4/2015 |
| WO | 2015/059465 A1 | 4/2015 |
| WO | 2015/077624 A1 | 5/2015 |
| WO | 2015/097220 A1 | 7/2015 |
| WO | 2015153912 A1 | 10/2015 |
| WO | 2015155370 A1 | 10/2015 |
| WO | 2016/030489 A1 | 3/2016 |
| WO | 2016/139463 A1 | 9/2016 |
| WO | 2016/146894 A1 | 9/2016 |
| WO | 2016/174200 A1 | 11/2016 |
| WO | 2017/103290 A1 | 6/2017 |
| WO | 2017/103291 A1 | 6/2017 |
| WO | 2017/161360 A2 | 9/2017 |
| WO | 2018/041827 A1 | 3/2018 |
| WO | 2018/041838 | 3/2018 |
| WO | 2018/075978 A1 | 4/2018 |
| WO | 2018/083257 A1 | 5/2018 |
| WO | 2018/083258 A1 | 5/2018 |
| WO | 2018/083259 A1 | 5/2018 |
| WO | 2019/043020 A1 | 3/2019 |
| WO | 2019/149829 A1 | 8/2019 |

OTHER PUBLICATIONS

Gravanis et al. Chin Clin Oncol, 2014, 3, pp. 1-5 (Year: 2014).*
Bean. PNAS 2018; 115(50): 12539-12543 (Year: 2018).*
Chia S.L. et al, Group B adenovirus enadenotucirev infects polarised colorectal cancer cells efficiently from the basolateral surface expected to be encountered during intravenous delivery to treat disseminated cancer, Virology 505:162, 2017.
Choi, K-J, et al., Concurrent delivery of GM-CSF and B7-1 using an oncolytic adenovirus elicits potent antitumor effect, Gene Ther. Jul. 2006;13(13):1010-20.
Alemany, R., Oncolytic Adenoviruses in Cancer Treatment, Biomedicines 2014, 2, 36-49.
Nemunaitis, J., et al., Intravenous infusion of a replication-selective adenovirus (ONYX-015) in cancer patients: safety, feasibility and biological activity, Gene Therapy (2001) 8, 746-759.
Hemminki, A., Oncolytic Immunotherapy: Where Are We Clinically?, Scientifica, vol. 2014, Article ID 862925, 7 pages.
Hobbs, W. E., et al., Efficient Activation of Viral Genomes by Levels of Herpes Simplex Virus ICP0 Insufficient to Affect Cellular Gene Expression or Cell Survival, Journal of Virology, Apr. 2001, p. 3391-3403.
Hu, Z-B, et al., A simplified system for generating oncolytic adenovirus vector carrying one or two transgenes, Cancer Gene Therapy vol. 15, pp. 173-182(2008).
Illingworth et al, ColoAd1 a group B oncolytic adenovirus: preclinical assessment of potency, safety and selectivity, Human gene therapy, vol. 23, No. 10, Oct. 2012, p. A19.
Jiang et al, The controlled transgene expression in oncolytic adenoviral vectors with major late promoter for therapy of cancer, Mol. Therapy 13(Supp 1), 2006, S251.
Kwon, O-J, et al., Therapeutic targeting of chitosan-PEG-folate-complexed oncolytic adenovirus for active and systemic cancer gene therapy, J Control Release, Aug. 10, 2013;169(3):257-65.
Lee, Y-S, et al., Enhanced Antitumor Effect of Oncolytic Adenovirus Expressing Interleukin-12 and B7-1 in an Immunocompetent Murine Model, Clin Cancer Res 2006;5859 12(19) Oct. 1, 2006.
Pol, J., et al., Trial Watch Oncolytic viruses for cancer therapy, OncoImmunology 3, e28694; Apr. 2014.
Pützer, B. M., et al., Improved treatment of pancreatic cancer by IL-12 and B7.1 costimulation: antitumor efficacy and immunoregulation in a nonimmunogenic tumor model, Mol Ther. Apr. 2002;5(4):405-12.
Small, E. J., A Phase I Trial of Intravenous CG7870, a Replication-Selective, Prostate-Specific Antigen-Targeted Oncolytic Adenovirus, for the Treatment of Hormone-Refractory, Metastatic Prostate Cancer, Molecular Therapy vol. 14, No. 1, Jul. 2006.
Nakashima, E., et al., A candidate for cancer gene therapy: MIP-1 alpha gene transfer to an adenocarcinoma cell line reduced tumorigenicity and induced protective immunity in immunocompetent mice, Pharm Res. Dec. 1996;13(12):1896-901.
Kaufman, H. L., et al., Oncolytic viruses: a new class of immunotherapy drugs, Nat Rev Drug Discov. Sep. 2015;14(9):642-62.
Ferrantini, M., et al., Interferon-alpha and cancer: mechanisms of action and new perspectives of clinical use, Biochimie. Jun.-Jul. 2007;89(6-7):884-93.
Plasmids 101: Multicistronic Vectors. Jan. 29, 2015, https://web.archive.org/web/20150129022727/https://blog.addgene.org/plasmids-101-multicistronic-vectors.

(56) References Cited

OTHER PUBLICATIONS

Gene Therapy Vaccinia Virus Vectors Explained. Feb. 1, 2015, https://web.archive.org/web/20150201083914/www.genetherapynet.com/viral-vector/vaccinia-viruses.html.
Yu Feng et al, "Cancer Associated Fibroblasts-Targeted Oncolytic Virus Results in Enhanced Antitumor Activity in Mouse Model", Molecular Therapy,vol. 23, No. Suppl. 1, May 2015 (May 2015), p. S246.
Carlos Alberto Fajardo et al, "Oncolytic Adenoviral Delivery of an EGFR-Targeting T-cell Engager Improves Antitumor Efficacy", Cancer Research,vol. 77, No. 8, Apr. 15, 2017 (Apr. 15, 2017), p. 2052-2063.
International Search Report for PCT/EP2018/073160, dated Dec. 4, 2018.
Mukherjee et al, Identification of EpCAM as a Molecular target of prostate cancer stroma, American J of pathology, vol. 175, No. 6 , Dec. 1, 2009, 2277-2287.
Demers et al, Pharmacologic indicators of antitumor efficacy for oncolytic virotherapy, Cancer research, vol. 63, No. 14 (Jul. 15, 2003), 4003-4008.
Oorschot et al, Apoptin induces apoptosis in human transformed and malignant cells but not in normal cells, PNAS, May 1997, vol. 94, pp. 5843-5847.
Parks et al, Adenoviral vectors: prospects for gene delivery to the central nervous system, Gene Therapy, 1999, vol. 6, 1349-1350.
Boni et al, A Phase 1 Mechanism of Action Study of Intra-Tumoural (IT) or Intravenous (IV) Administration of Enadenotucirev, an Oncolytic AD11/AD3 Chimeric Group B Adenovirus in Colon Cancer Patients Undergoing Resection of Primary Tumour, Annals of Oncology 25 (supplement 4): iv361-iv372, 2014.
Nettelbeck et al, Cellular genetic tools to control oncolytic adenoviruses for virotherapy of cancer, J Mol Med (2008) 86:363-377.
Di, Y., et al, Activity of a Group B Oncolytic Adenovirus (ColoAd1) in Whole Human Blood, Gene Ther. Apr. 2014;21(4):440-3.
Puthupparampil et al, Tumor growth inhibition from tumor targeted delivery of diphtheria toxin gene, Mol Therapy, 2005, vol. 11, supplement No. 1, A124.
Human Vaccines & Immunotherapeutics 8:11, 1550-1553; Nov. 2012, Unique anti-cancer agent ColoAd1 enters the clinic, www.landesbioscience.com.
Fuerer and Iggo, 5-Fluorocytosine increases the toxicity of Wnt-targeting replicating adenoviruses that express cytosine deaminase as a late gene, Gene Therapy (2004), 11, 142-151.
Rancourt et al, Conditionally replicative adenoviruses for cancer therapy, 6th delivery review 27 (1997): 67-81.
Richards et al, The Amid system: Generation of recombinant adenoviruses by Tn7-mediated transposition in E. coli, Biotechniques vol. 29, No. 1, 146-154 (2000).
Roshon et al, Gene trap mutagenesis of hnRNP A2/B1: a cryptic 3' splice site in the neomycin resistance gene allows continued expression of the disrupted cellular gene, BMC Genomics, vol. 4, No. 2, 1-11 (2003).
Sirena et al, The nucleotide sequence and a first generation gene transfer vector of species B human adenovirus serotype 3, Virol. 343, 283-98 (2005).
Sood et al, Functional role of matrix metalloproteinases in ovarian tumor cell plasticity, Am. J. Obstetrics Gynecol. 196, 899-909 (2004).
Stellwagan et al, Gain of function mutations in TnsC, an ATP-dependent transposition protein that activates the bacterial transposon Tn7, Genetics 145: 573-585 (1997).
Stevenson et al, Selective targeting of human cells by a chimeric adenovirus vector containing a modified fiber protein, J virol. vol. 71, No. 6, 4782-4790, (1997).
Stone, D., et al, Development and Assessment of Human Adenovirus Type 11 as a Gene Transfer Vector, J Virol. Apr. 2005;79(8):5090-104.
Tedcastle A. et al, Actin-resistant DNAse I Expression From Oncolytic Adenovirus Enadenotucirev Enhances Its Intratumoral Spread and Reduces Tumor Growth, Mol Ther. 24:796, 2014.

Thorne et al, Oncolytic virotherapy: Approaches to tumor targeting and enhancing antitumor effects, Sem oncol. 32, 537-48, Dec. 1, 2005.
Tobias et al, Novel primate-crossreactive BiTE antibodies that eliminate cancer cells expressing cMEt, IGFR-1, FAP-alpha, PSCA, Endosialin, CAIX or Her2/neu, Proceedings of annual meeting of American association for cancer res, vol. 51, p. 590.
Tollefson et al, The Adenovirus Death Protein (E3-11.6K) is Required at Very Late Stages of Infection for Efficient Cell Lysis and Release of Adenovirus from Infected Cells, Journal of Virology, Apr. 1996, vol. 70, No. 4, pp. 2296-2306.
Wang et al, High levels of EGFR expression in tumor stroma are associated with aggressive clinical features in epithelial ovarian cancer, Oncotargets and therapy, vol. 9, Jan. 19, 2016, 377-386.
Yan et al, Developing Novel Oncolytic Adenoviruses through bioselection, J Virol. vol. 77, No. 4, Feb. 2003, 2640-2650.
Raki, M., et al, Oncolytic Adenovirus Ad5/3-delta24 and Chemotherapy for Treatment of Orthotopic Ovarian Cancer, Gynecol Oncol. Jan. 2008;108(1):166-72.
Russell, S. J., et al, Oncolytic Virotherapy, Nat Biotechnol. Jul. 10, 2012;30(7):658-70.
Vellinga, J., et al, The Adenovirus Capsid: Major Progress in Minor Proteins, J Gen Virol. Jun. 2005;86(Pt 6):1581-1588.
Jin, F., et al., Identification of Novel Insertion Sites in the Ad5 GenomeThat Utilize the Ad Splicing Machinery forTherapeutic Gene Expression, MolecularTherapy vol. 12, No. 6, Dec. 2005.
Hermiston, T.W., et al., Review Armed therapeutic viruses: Strategies and challengesto arming oncolytic viruses with therapeutic genes, Cancer Gene Therapy (2002) 9, 1022-1035.
Funston, G. M., et al., Expression of heterologous genes in oncolytic adenoviruses using picornaviral 2A sequences that trigger ribosome skipping, J Gen Virol . Feb. 2008;89(Pt 2):389-396.
Lee, C. H., et al., Tumor-localized ligation of CD3 and CD28 with systemic regulatory T-cell depletion induces potent innate and adaptive antitumor responses, Clin Cancer Res . Apr. 15, 2009;15(8):2756-66.
Liao, K.W., et al., Activation of lymphocytes by anti-CD3 single-chain antibody dimers expressed on the plasma membrane of tumor cells, Gene Ther. Feb. 2000;7(4):339-47.
Paul et al, Tumor gene therapy by MVA-mediated expression of T-cell stimulating antibodies, Cancer gene therapy vol. 9, No. 5, 2002, 470-477.
Stone, D., et al., The complete nucleotide sequence, genome organization, and origin of human adenovirus type 11, Virology 309 (2003) 152-165.
Holterman, L., et al., Novel Replication-Incompetent Vector Derived from Adenovirus Type 11 (Ad11) for Vaccination and Gene Therapy: Low Seroprevalence and Non-Cross-Reactivity with Ad5, Journal of Virology, Dec. 2004, p. 13207-13215.
Calvo et al, A First-in-class, a first-in-human phase I study of enadenotucirv an oncolytic Ad11/Ad3 chemeric group B adenovirus, administered intravenously in patients with metastatic epithelial tumors, Journal of Clinical Oncology vol. 32, No. 15 suppl (May 2014), abstract 3103.
Lee, Y-S, et al., Enhanced Antitumor Effect of Oncolytic Adenovirus Expressing Interleukin-12 and B7-1in an Immunocompetent Murine Model, Clin. Cancer Res 2006;12(19) Oct. 1, 2006.
Paul, S., et al., Tumor gene therapy by MVA-mediated expression of T-cell-stimulating antibodies, Cancer Gene Therapy (2002) 9, 470-477.
Raum, T. J., et al., Abstract 2434: Novel primate-crossreactive BiTE antibodies that eliminate cancer cells expressing cMet, IGFR-1, FAP-alpha, PSCA, Endosialin, CAIX or Her2/neu, AACR 101st Annual Meeting 2010—Apr. 17-21, 2010; Washington, DC.
Yang, Z-M, et al., Anti-CD3 scFv-B7.1 fusion protein expressed on the surface of HeLa cells provokes potent T-lymphocyte activation and cytotoxicity, Biochem Cell Biol. Apr. 2007;85(2):196-202.
Diehl, K-H., et al., A Good Practice Guide to the Administration of Substances and Removal of Blood, Including Routes and Volumes, J. Appl. Toxicol. 21, 15-23 (2001).
Ahmed et al, Intratumoral expression of a fusogenic membrane glycoprotein enhances the efficacy of replicating adenovirus therapy, Gene Therapy (2003) vol. 10, pp. 1663-1671.

(56) References Cited

OTHER PUBLICATIONS

Champion, AACR 106th Annual Meeting, Abstract 295: Delivery of checkpoint inhibitor antibodies and other therapeutics directly to tumors by encoding them within the oncolytic adenovirus enadenotucirev, 2015, vol. 75 (15: supple), Apr. 18, 2015, A295.
Alisky et al, Gene transfer to brain and spinal cord using recombinant adenoviral vectors, Methods in Mol Biol, vol. 246, 91-120, 2004.
Arafat et al, Effective single chain antibody (scFv) concentrations in vivo via adenoviral vector mediated expression of secretory scFv, Gene therapy, vol. 9, 256-262 (2002).
Biery et al, A simple in vitro Tn7-based transposition system with low target site selectivity for genome and gene analysis, Nucleic acids res, 28: 1067-1077 (2000).
Cascone et al, Upregulated stromal EGFR and vascular remodelling in mouse xenograft models of angiogenesis inhibitor-resistant human lung adenocarcinoma, J. clinical invest, vol. 121, No. 4, Apr. 1, 2011, 131-1328.
Casimiro et al, Comparative immunogenicity in rhesus monkeys of DNA plasmid, recombinant vaccinia virus and replication-defective adenovirus vectors, J. Virol 77, 6305-13 (2003).
Database WPI, Week 20267 (See also CN 102586327).
Mizuguchi et al, Approaches for generating recombinant adenovirus vectors, Advanced Drug Delivery Reviews, 2001, vol. 52, pp. 165-176.
Champion et al, Jul. 2016, Developing tumor-localized, combination immunotherapies, http://psioxus.com/wp-content/uploads/2016/12/AACR-Poster-Apr-2016.pdf.
Dyer et al, Oncolytic Group B adenovirus Enadenotucirev mediates non-apoptotic cell death with membrane disruption and release of inflammatory mediators, Molecular therapy Oncolytics, vol. 4, Mar. 2017, 18-30.
Dyer A. et al, Antagonism of Glycolysis and Reductive Carboxylation of Glutamine Potentiates Activity of Oncolytic Adenoviruses in Cancer Cells, Cancer Res. 79:331 , 2019.
Fajardo et al, Bi-specific T-Cell Engager-Armed oncolytic adenoviruses as a strategy to improve antitumor efficacy, Human Gene Therapy, vol. 26, No. 9, A13-A14, Sep. 2015.
Kuhn, I, et al., Human adenovirus B strain ColoAd1, complete genome, GenBank: EF011630.1.
Kuhn, I., et al., Directed evolution generates a novel oncolytic virus for the treatment of colon cancer, PLoS One. Jun. 18, 2008;3(6):e2409.
Mei et al, Comparative analysis of the genome organization of human adenovirus 11, a member of the human adenovirus species B, and the commonly used human adenovirus 5 vector, a member of species C, J Gen Virol. vol. 84, No. part 8, Aug. 2003, 2061-2071.
Freedman et al, Oncolytic adenovirus expressing bispecific antibody targets T-cell cytotoxicity in cancer biopsies, EMBO molecular med, vol. 9, No. 8, Jun. 20, 2017, 1067-1087.
Freedman J.D. et al, An Oncolytic Virus Expressing a T-cell Engager Simultaneously Targets Cancer and Immunosuppressive Stromal Cells, Cancer Res Nov 18: 1-14, 2018.
Frentzen et al, Anti-VEGF single=chain antibody GLAF-1 encoded by oncolytic vaccinia virus significantly enhances anti-tumor therapy, Proceedings Nat Aca Sci, vol. 106, No. 31, (Aug. 4, 2009), 12915-12920.
Forrester et al, Serotype-specific inactivation of the cellular DNA damage response during adenovirus infection, J. Vir 85(5), 2011, 2201-2211.
Fountzilas et al, Review: Oncolytic virotherapy, updates and future directions, Oncotarget, vol. 8, No. 60, May 31, 2017.
Fu et al, Expression of a Fusogenic Membrane Glycoprotein by an Oncolytic Herpes Simplex Virus Potentiates the Viral Antitumor Effect, Molecular Therapy, Jun. 2003, vol. 7, No. 6, pp. 748-754.
Galanis et al, Use of Viral Fusogenic Membrane Glycoproteins as Novel Therapeutic Transgenes in Gliomas, Human Gene Therapy, 2001, vol. 12, No. 7, pp. 811-821, Abstract.
Garcia-carbonero et al, Phase I study of intravenous administration of the chimeric adenovirus enadenotucirev in patients undergoing primary tumor resection, J immunotherapy of cancer, Biomed central ltd, vol. 5, No. 19 Sep. 2017, 1-13.
Grill et al, Mol. The organotypic multicellular spheroid is a relevant three-dimensional model to study adenovirus replication and penetration in human tumors in vitro, Therapy, vol. 6, No. 5, 609-614 (2002).
Heise et al, Onyx-015, an E1B gene-attenuated adenovirus, causes tumor-specific cytolysis and antitumoral efficacy that can be augmented by standard chemotherapeutic agents, Nat Met, vol. 3, No. 6, 639-645, 1997.
Champion et al, NG-348: a novel oncolytic virus designed to mediate anti-tumour activity via the potent and selective polyclonal activation of tumor-infiltrating T-cells, Cancer research, vol. 77, No. 13, Jul. 2017.
Hermiston, A demand for next-generation oncolytic adenoviruses, Curr. Op. Mol. Therapeutics 8, 322-30, Aug. 2006.
Machiels J-P. et al, A Phase 1 Dose Escalation Study of the Oncolytic Adenovirus Enadenotucirev, Administered Intravenously to Patients with Epithelial Solid Tumors, (EVOLVE) Journal for ImmunoTherapy of Cancer 7:20, 2019.
Hermiston T., Gene delivery from replication-selective viruses: arming guided missiles in the war against cancer, J Clinical invest, vol. 105, No. 9, (May 1, 2000), 1169-1172.
Ibrahimi et al, Highly efficient multicistronic lentiviral vectors with peptide 2A sequences, Human gene therapy 20: 845-860.
Illingworth et al, Preclinical Safety Studies of Enadenotucirev, a Chimeric Group B Human-Specific Oncolytic Adenovirus, Mol Ther Oncolytics. 5:62, 2017.
Hermiston T. et al, The Discovery and Development of Selectively Replicating Adenoviruses-Anticancer Agents, J Tumor targeting 2000, vol. 4 No. 4, 218-224.
Jolly D et al, Viral vector systems for gene therapy, Cancer gene therapy, vol. 1, No. 1, (1994) 51-64.
Kanerva et al, Gene transfer to ovarian cancer vs normal tisuses with fiber-modified adenoviruses, Molecular Therapy, vol. 5 (6), 2002, 695-704.
Kleinman & Martin, Matrigel: Basement membrane matrix with biological activity, Seminars in cancer biology 15, 378-86, Oct. 1, 2005.
Lai et al, Adenovirus and adeno-associated virus vectors, DNA Cell Bio, vol. 21, No. 12, 895-913 (2002).
Kuhn et al, 319. ColoAd1, a chimeric Ad11p/Ad3 Oncolytic virus for the treatment of colon cancer, Molecular Therapy, vol. 11, Aug. 15, 2005, p. 124.
Lee et al, Replicating adenoviral vector-mediated transfer of a heat-inducible double suicide gene for gene therapy, Cancer gene therapy, vol. 8, No. 6, 397-404 (2001).
Liao et al, Stable expression of chimeric anti-CD3 receptors on mammalian cells for stimulation of anti-tumor immunity, Cancer gene therapy 10, 2003, 779-790.
Kangasniemi et al, Improving oncolytic adenoviral therapies for gastro-intestinal cancers and tumor initiating cells, Cancer Gene Therapy Group, Jan. 1, 2010, 1-70.
Luckow et al, Efficient generation of infectious recombinant baculoviruses by site-specific transposon-mediated insertion of foreign genes into a baculovirus genome propagated in *Esherichia coli*, J. Vorl. 67: 4566-4579 (1993).
Marino et al, Development of a versatile oncolytic virus platform for local intra-tumoral expression of therapeutic transgenes, pLOS One, May 18, 2017, 1-23.
McConnell & Imperiale, Biology of adenovirus and its use as a vector for gene therapy, Human Gene therapy 1022-1033, Nov. 11, 2014.
McVey et al, Rapid construction of adenoviral vectors by lambda phage genetics, J. Virol, vol. 76, No. 8, 3670-3677 (Apr. 2002).
Meinschad & Winnacker, Recombination in adenovirus. I. Analysis of recombinant viruses under non-selective conditions, J of Gen. Virol. 1980, vol. 48, 219-224.
Francini, N. et al, Polyvalent Diazonium Polymers Provide Efficient Protection of Oncolytic Adenovirus Enadenotucirev from Neutralizing Antibodies while Maintaining Biological Activity In Vitro and In Vivo, Bioconjug Chem. 30:1244, 2019.

(56) References Cited

OTHER PUBLICATIONS

Champion, B. R., et al., Arming the chimeric oncolytic adenovirus enadenotucirev to deliver checkpoint inhibitors and other therapeutics directly to tumours, J Immunother Cancer. 2014; 2(Suppl 3): p. 46.
Dias, J. D., et al., Targeted cancer immunotherapy with oncolytic adenovirus coding for a fully human monoclonal antibody specific for CTLA-4, Gene Ther. Oct. 2012;19(10):988-98.
International Search Report and Written Opinion of PCT/EP2020/067668, dated Nov. 5, 2020.
Detergents: Triton X-100, Tween-20, and More, Jun. 10, 2020, Mater Methods 2013;3:163.
Clement, N., et al., Construction and production of oncotropic vectors, derived from MVM(p), that share reduced sequence homology with helper plasmids, Cancer Gene Ther. Sep. 2002;9(9):762-70.
Shashkova, E., et al., Characterization of human adenovirus serotypes 5, 6, 11, and 35 as anticancer agents, Virology Nov. 25, 2009;394(2):311-20.
Ferguson, M., et al., Systemic delivery of oncolytic viruses: hopes and hurdles, Advances in Virology, V 2012, Article ID 805629.
Carlisle, R.C., et al., Human erythrocytes bind and inactivate type 5 adenovirus by presenting Coxsackie virus-adenovirus receptor and complement receptor 1, Blood Feb. 26, 2009;113(9):1909-18.
Chau, L.A, et al., HuM291(Nuvion), a humanized Fc receptor-nonbinding antibody against CD3, anergizes peripheral blood T cells as partial agonist of the T cell receptor, Transplantation Apr. 15, 2001;71(7):941-50.
PsiOxus Therapeutics, Ltd, Press Release, PsiOxus Therapeutics to Release Study Results of Oncolytic Vaccine Enadenotucirev in Cancer Patients, Oxford, UK, Apr. 13, 2014.
Wüest et al, Construction of a bispecific single chain antibody for recruitment of cytotoxic T cells to the tumor stroma associated antigen fibroblast activation protein, Journal of Biotechnology 92 (2001), 159-168.
Vogels et al, Replication-deficient human adenovirus type 35 vectors for gene transfer and vaccination: efficient human cell infection and bypass of preexisting adenovirus immunity, J of Virology, vol. 77, No. 15, Aug. 2003, 8263-8271.
Reid et al, Intravascular adenoviral agents in cancer patients: lessons from clinical trials, Cancer Gene Therapy (2002), 9, 979-986.
Laurie et al, A phase 1 clinical study of intravenous administration of PV701, an oncolytic virus, using two-step desensitization, Clin Cancer Res 2006; 12(8), Apr. 15, 2006.
Hotte et al, An optimized clinical regimen for the oncolytic virus PV701, Clin Cancer Res, 2007; 13(3), Feb. 1, 2007.
Hemminki et al, Ad3-hTERT-E1A, a fully serotype 3 oncolytic adenovirus, in patients with chemotherapy refractory cancer, Molecular Therapy, vol. 20, No. 9, 1821-1830, Sep. 2012.
Garcia-carbonero et al, ASCO Meeting library Jun. 3, 2014, A phase 1 mechanism of action study of intratumoral or intravenous administration of enadenotucirev, an oncolytic Ad11/AD3 chimeric group B adenovirus in colon cancer patients undergoing resection of primary tumor.
Fisicaro et al., Versatile Co-expression of Graft-Protective Proteins Using 2A-Linked Cassettes, Xenotransplantation (2011), 18(2):121-130.
Chang, C-M, et al., Treatment of hepatocellular carcinoma with adeno-associated virus encoding interleukin-15 superagonist, Hum Gene Ther. May 2010;21(5):611-21.
Cheng, L., et al., Hyper-IL-15 suppresses metastatic and autochthonous liver cancer by promoting tumour-specific CD8+ T cell responses, J Hepatol. Dec. 2014;61(6):1297-303.
Guo, Y., et al., Immunobiology of the IL-15/IL-15Rα complex as an antitumor and antiviral agent, Cytokine Growth Factor Rev. Dec. 2017;38:10-21.
Ni, S., et al., Evaluation of biodistribution and safety of adenovirus vectors containing group B fibers after intravenous injection into baboons, Hum Gene Ther. Jun. 2005;16(6):664-77.
Murphy et al., Enhancing Recombinant Abtibody Performance by Optimally Engineering Its Format, Journal of Immunological Methods (2018), 463:127-133.
Paul, Fundamental Immunology, Third Edition, Laboratory of Immunology, National Institute of Allergy and Infectious Diseases, National Institutes of Health (1993), 292-295.
Rudikoff et al., Single Amino Acid Substitution Altering Antigen-Binding Specificity, Proc. Natl. Acad. Sci. (1982), 79:1979-1983.
Bendig, Humanization of Rodent Monoclonal Antibodies by CDR Grafting, A Companion to Methods in Enzymology (1995), 8:83-93.
Colman, Effects of Amino Acid Sequence Changes on Antibody-Antigen Interactions, Research in Immunology (1994), 145:33-36.
Khantasup et al., Design and Generation of Humanized Single-Chain Fv Derived From Mouse Hybridoma for Potential Targeting Application, Monoclonal Antibodies in Immunodiagnosis and Immunotherapy (2015), 34(6):404-417.
Riedmann, Human Vaccines: News, Human Vaccines & Immunotherapeutics (2012), 8(11):1550-1553.

* cited by examiner

Virus Replication in A549 Cells

Figure 2B     Virus Replication in MDA-MB-453 Cells
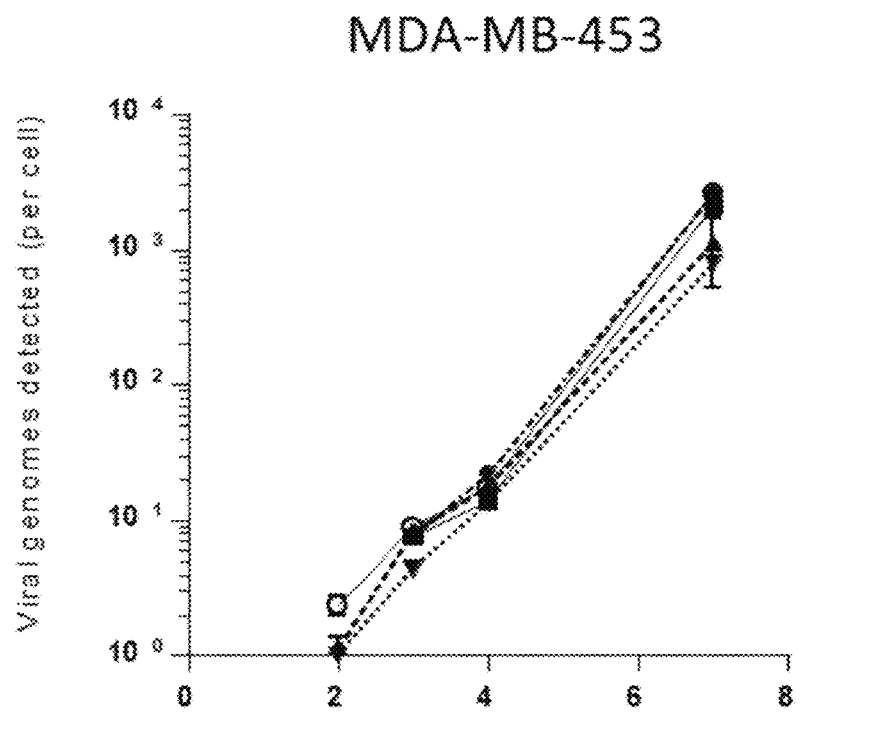
Figure 2C     Virus Replication in RT4 Cells
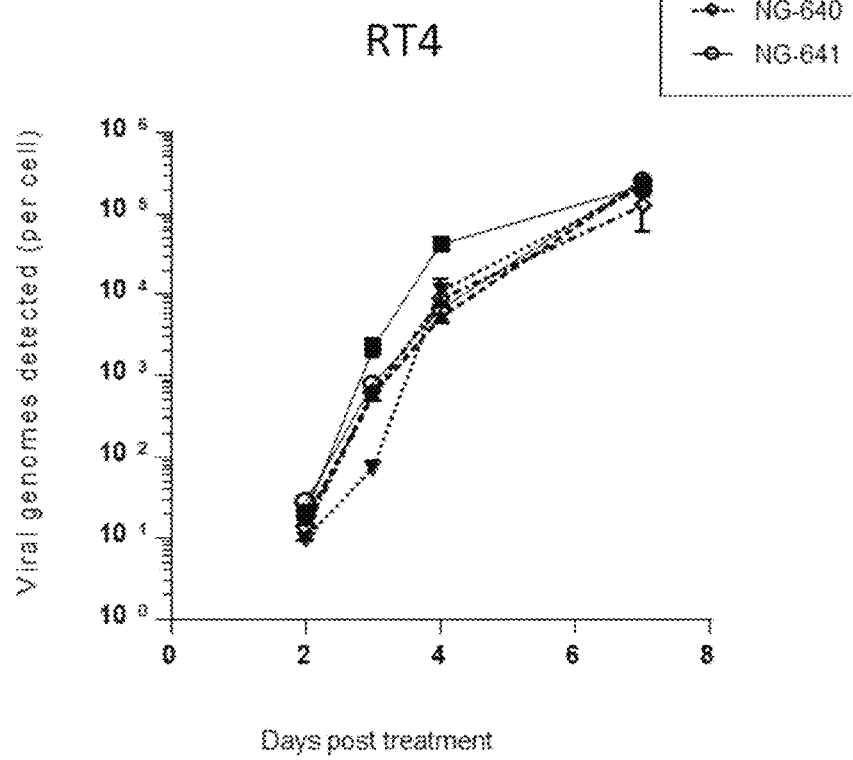

Figure 4 Cytokine Transgene Expression for NG-615 in Lung and Carcinoma Cells
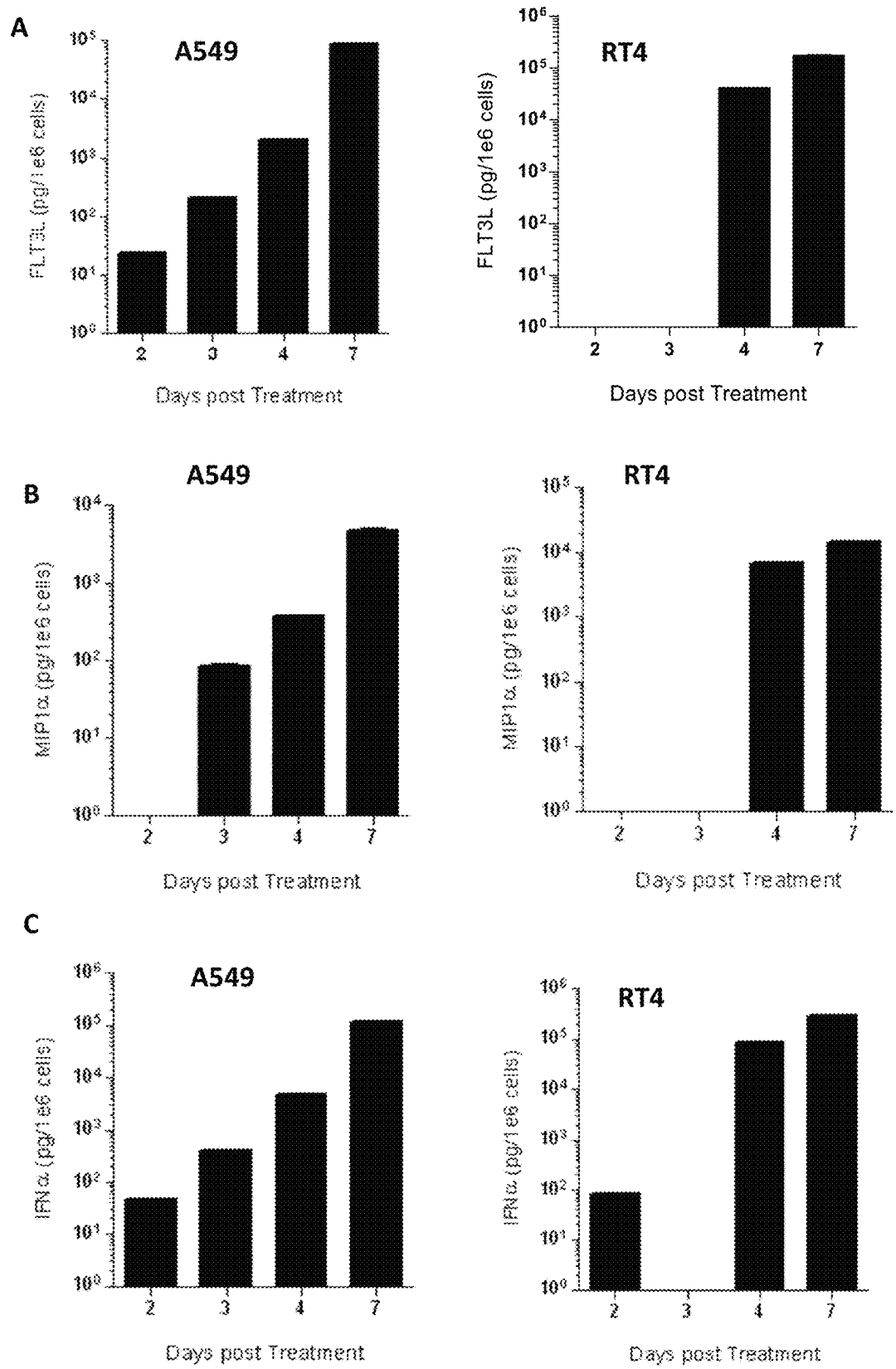

Figure 5 Cytokine Transgene Expression for NG-641 in Lung and Carcinoma Cells
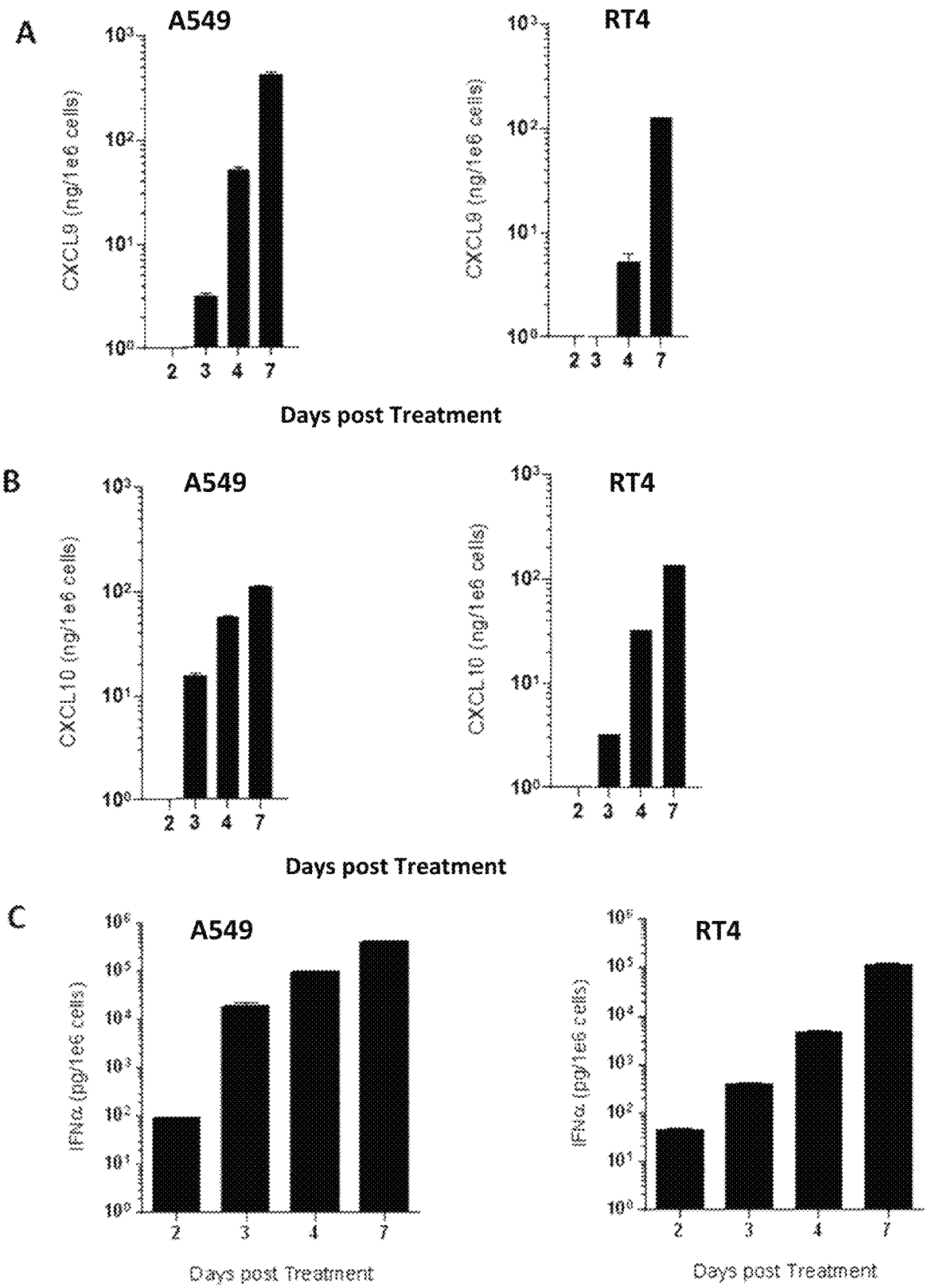

Figure 7
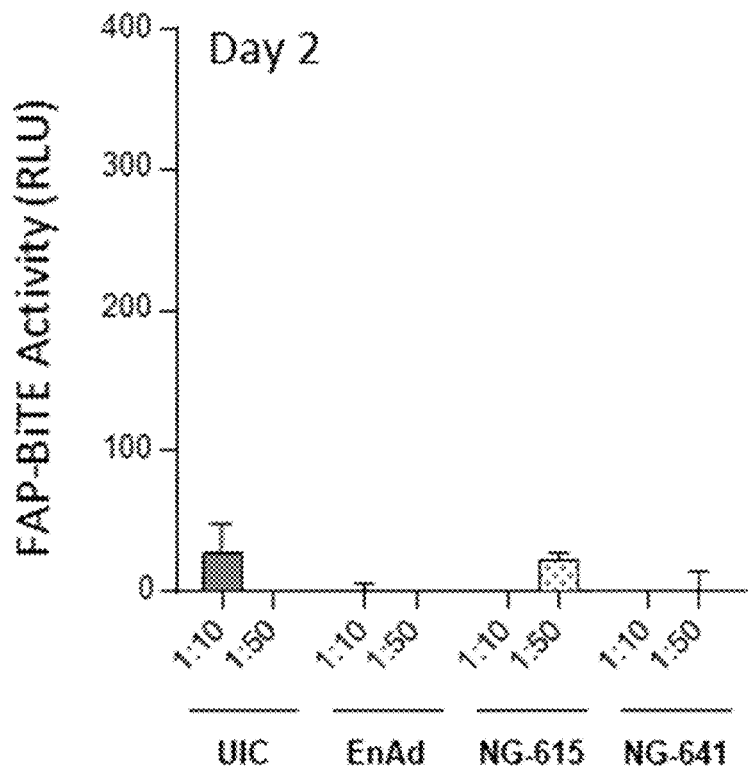
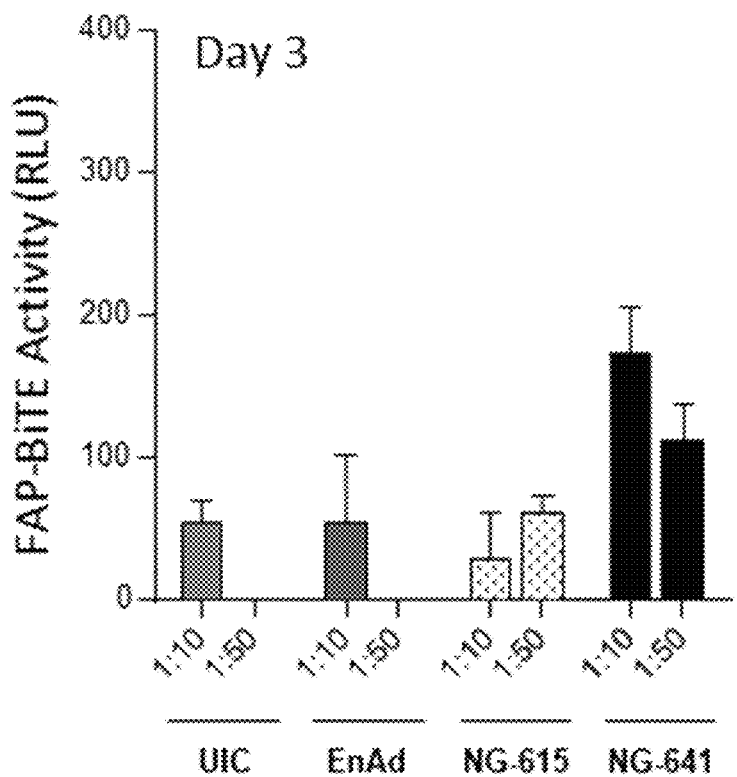

NG-615 only tested with T016 and T017 NSCLC tumour samples

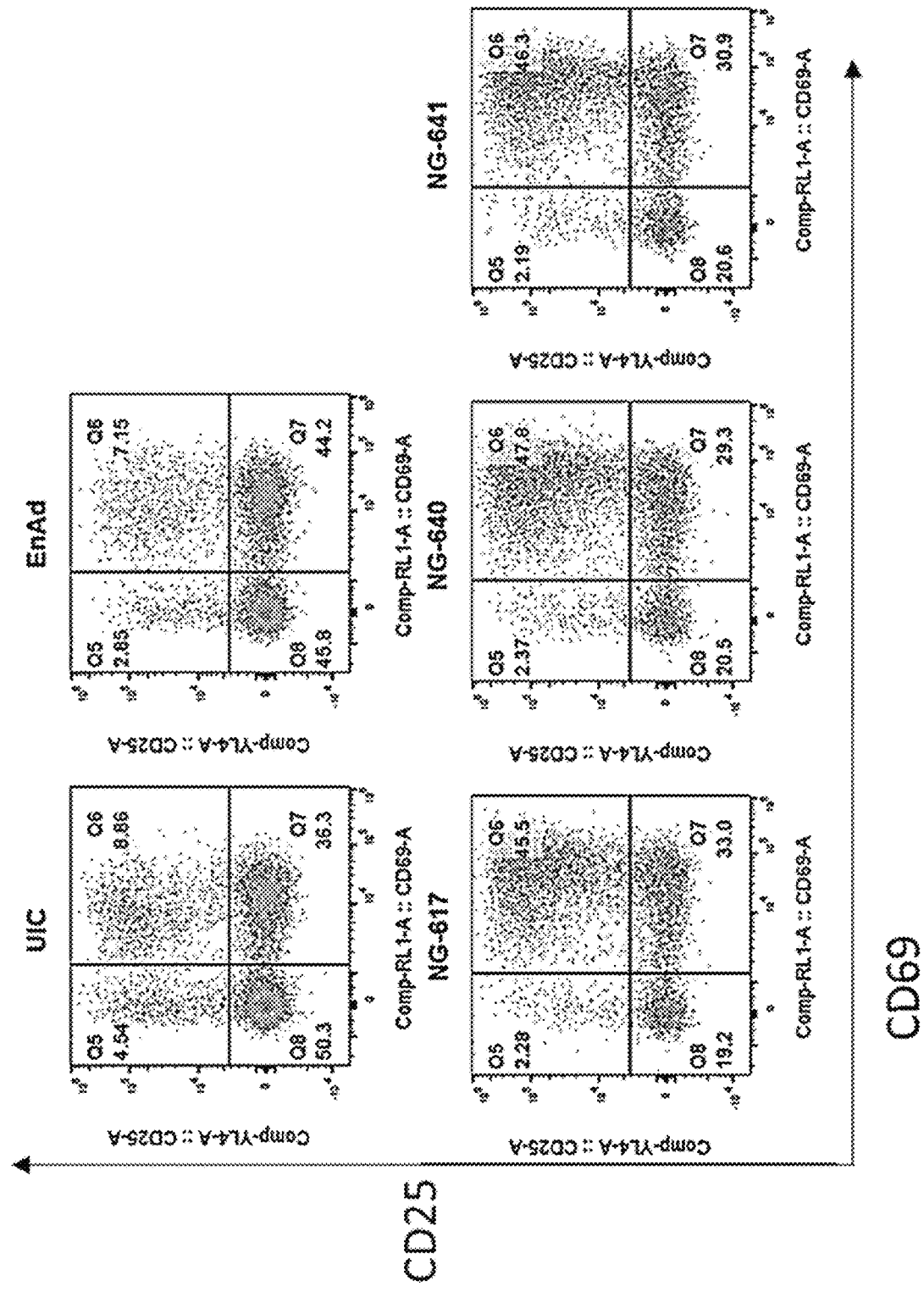
Figure 11A (X-axis Comp-RL1-A:CD69-A, Y-axis Comp-YL4-A: CD25-A)

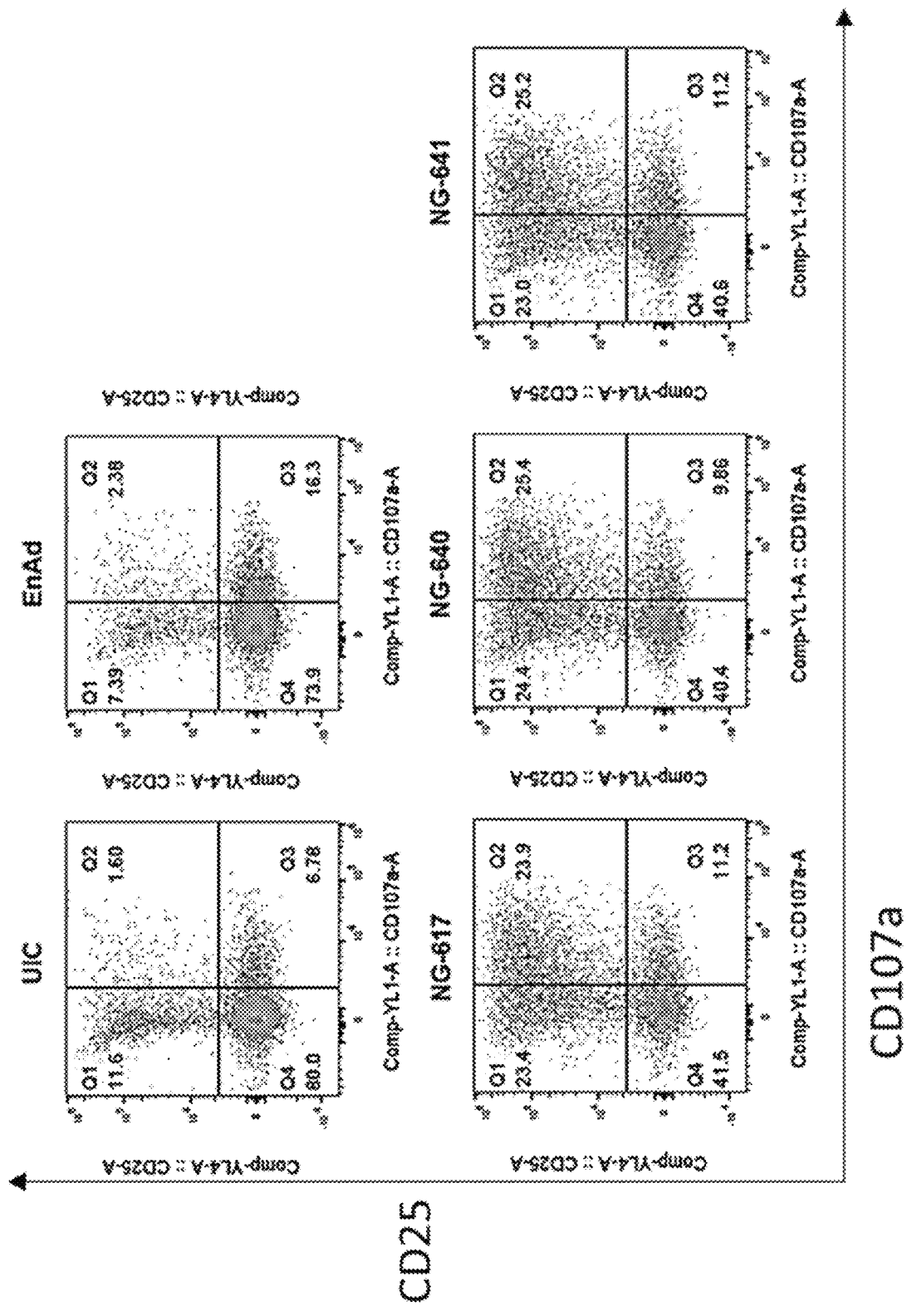
Figure 11A Cont. (X-axis Comp-YL1A:107a-A, Y-axis Comp-YL4-A: CD25-A)

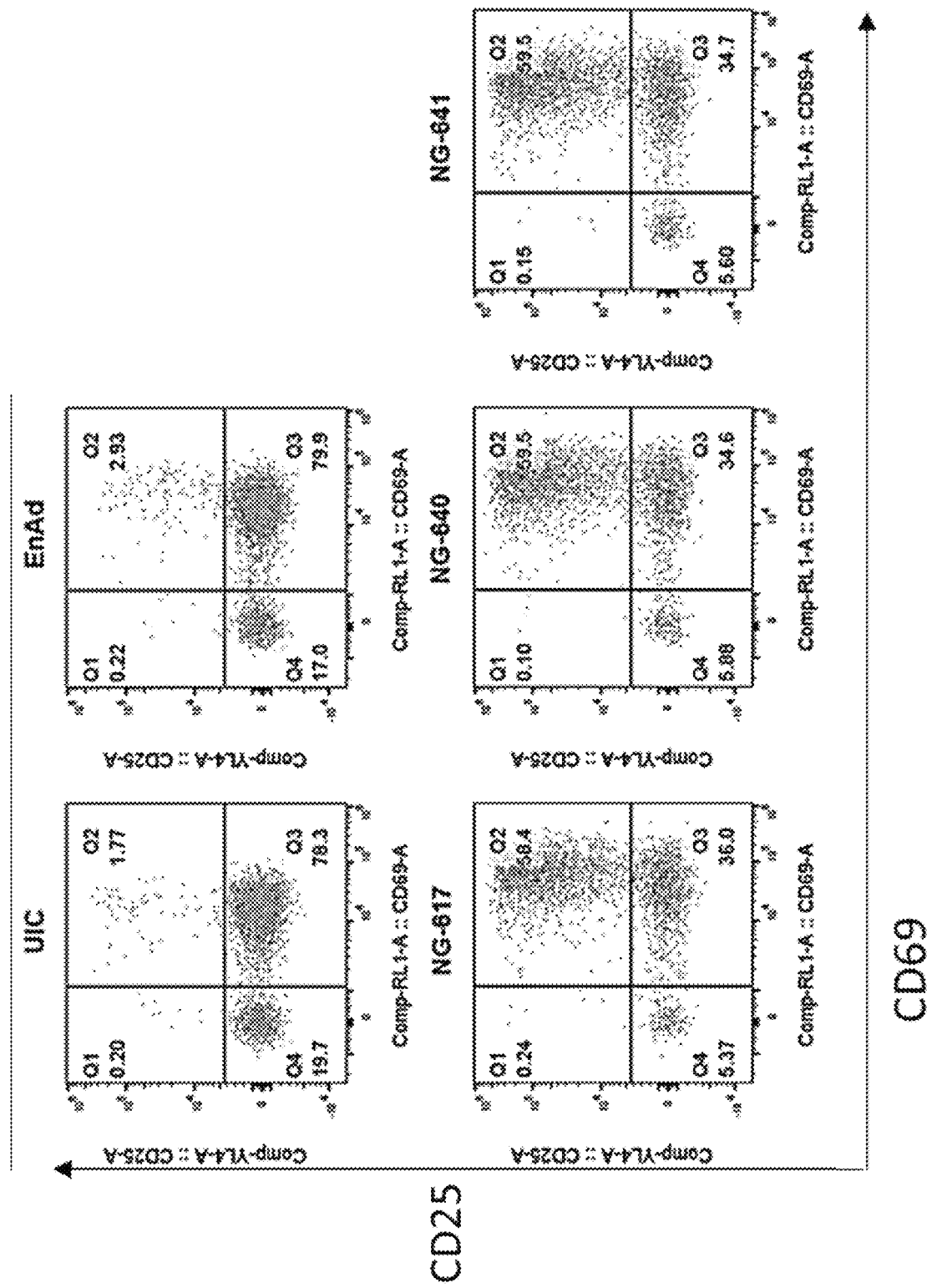
Figure 11B (X-axis Comp-RL-A:CD69-A, Y-axis Comp-YL4-A: CD25-A)

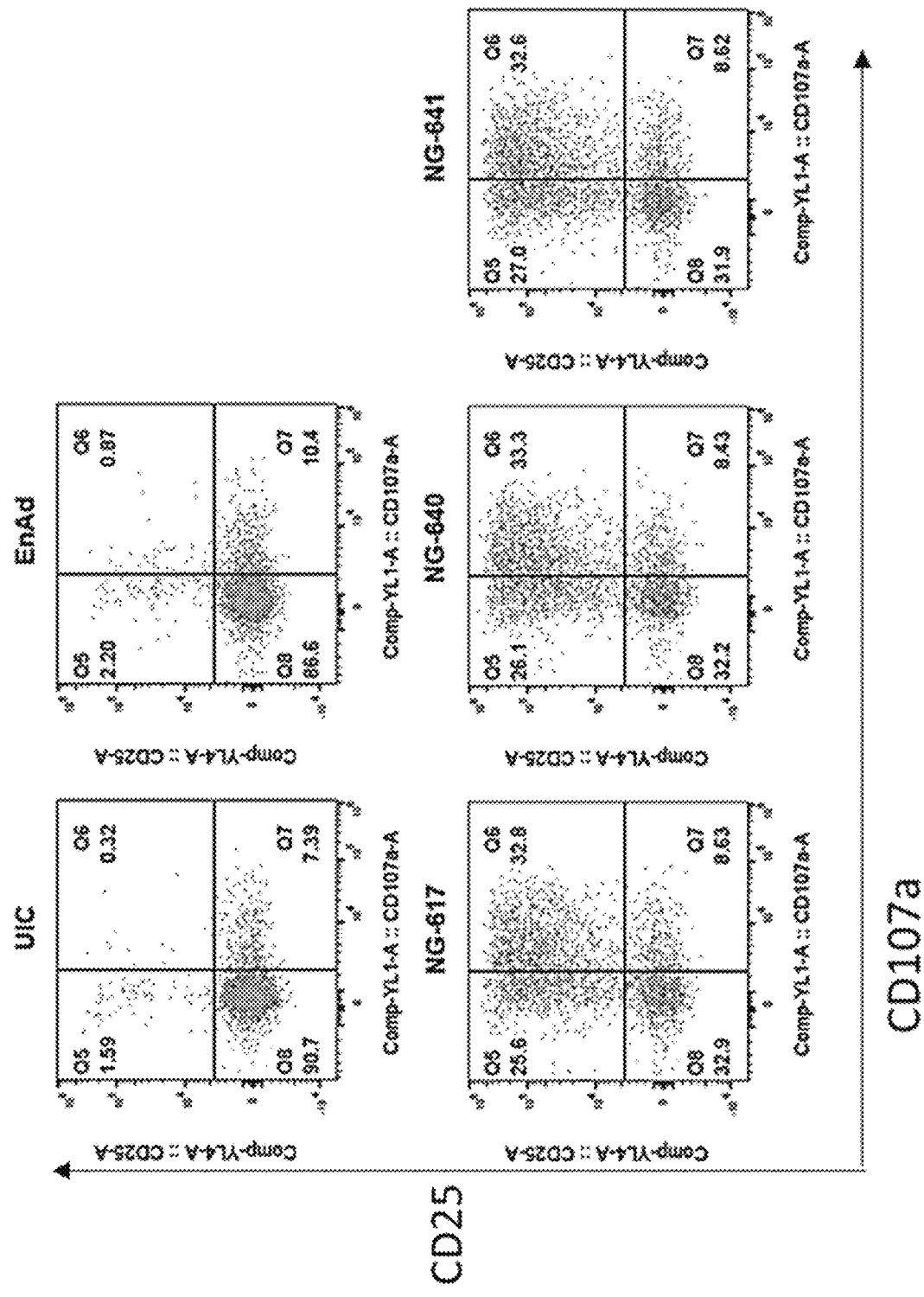
Figure 11B Cont. (X-axis Comp-YL1-1:CD107-a-A, Y-axis Comp-YL4-A: CD25-A)

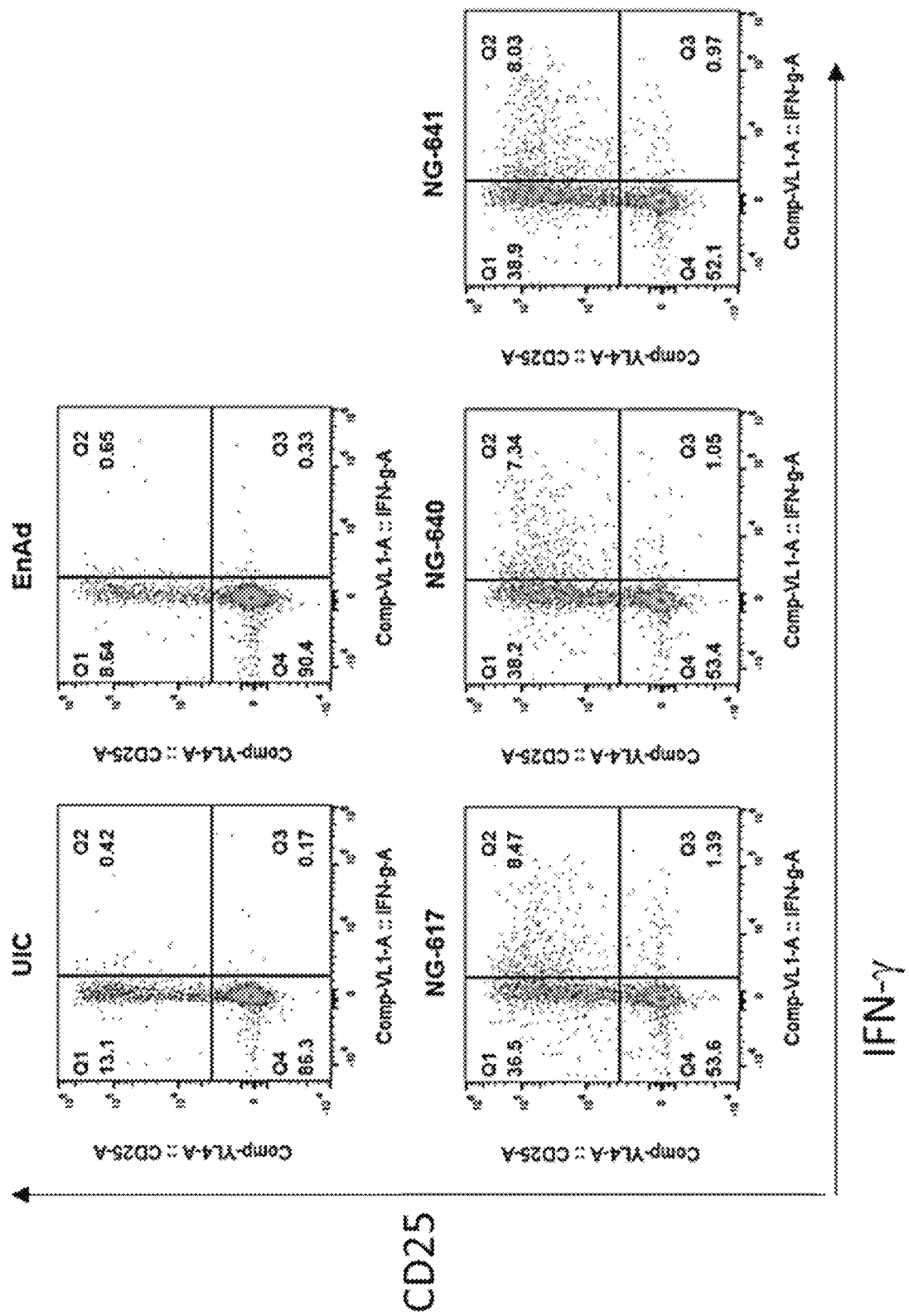
Figure 11C (X-axis Comp-VL1-A: IFN-g-A, Y-axis Comp-YL4-A: CD25-A)

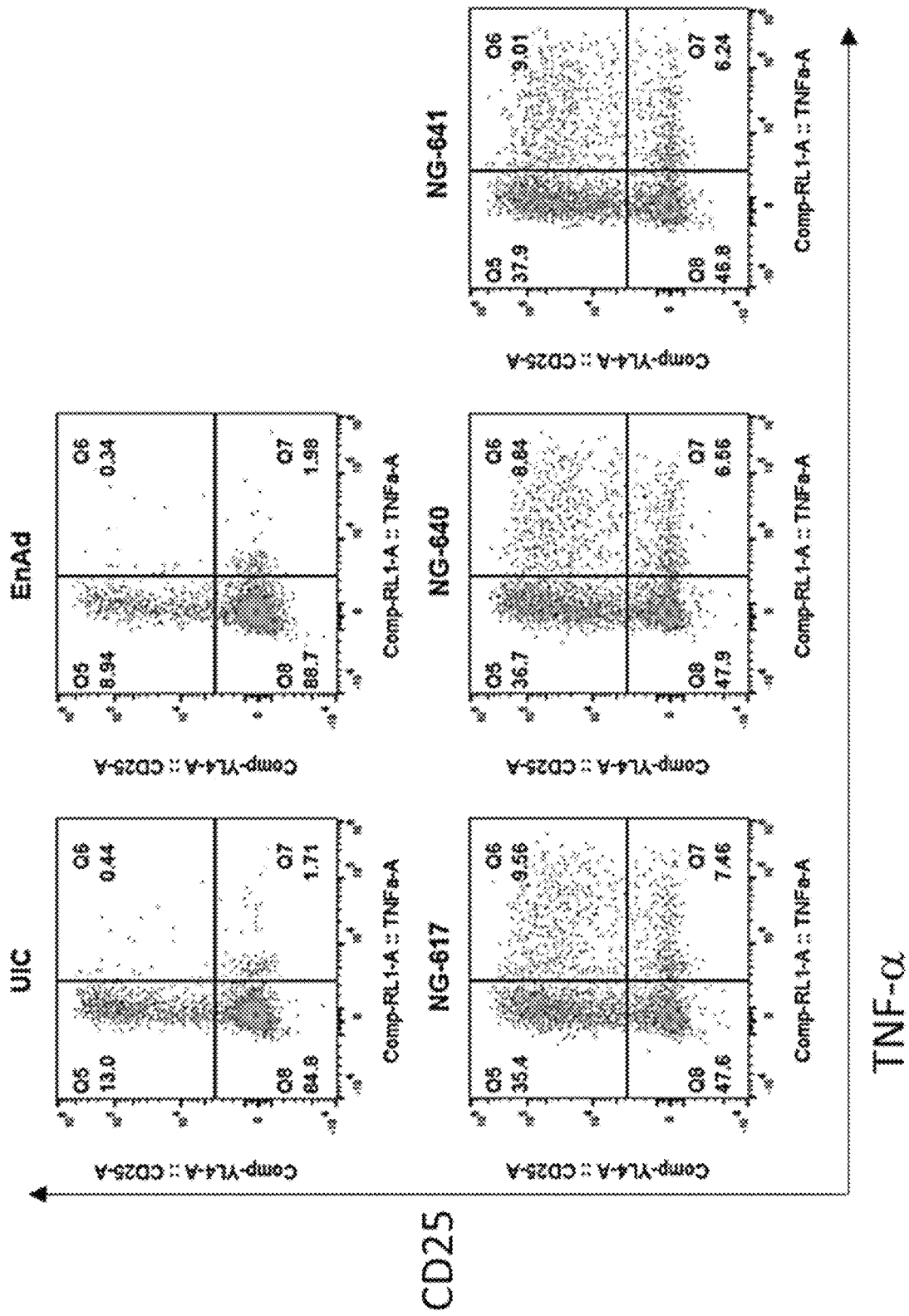
Figure 11C Cont. (X-axis Comp-RL1-A:TNF-a-A, Y-axis Comp-YL4-A: CD25-A)

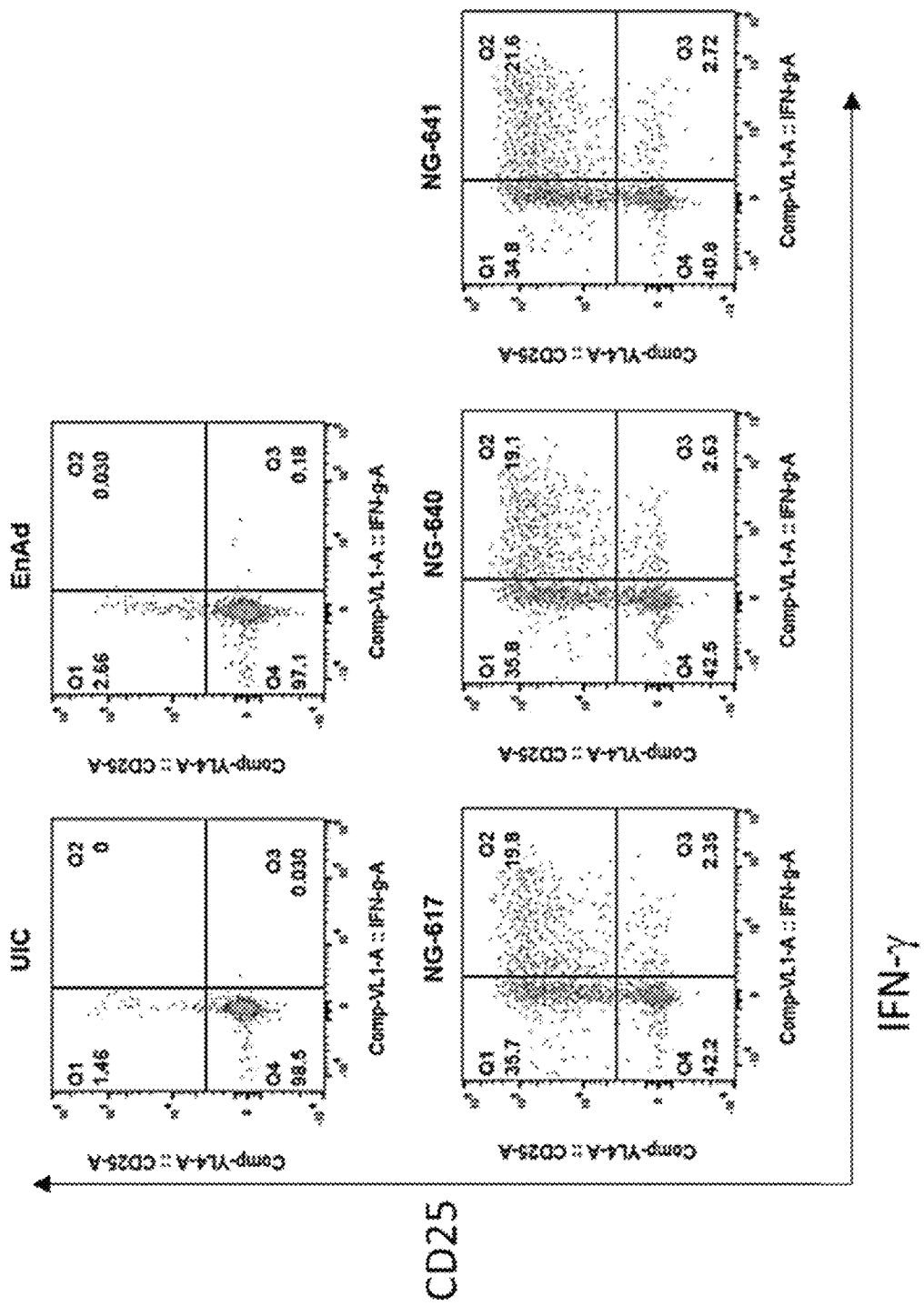
FIGURE 11D (X-axis Comp-VL-A: IFN-g-A, Y-axis Comp-YL4-A: CD25-A)

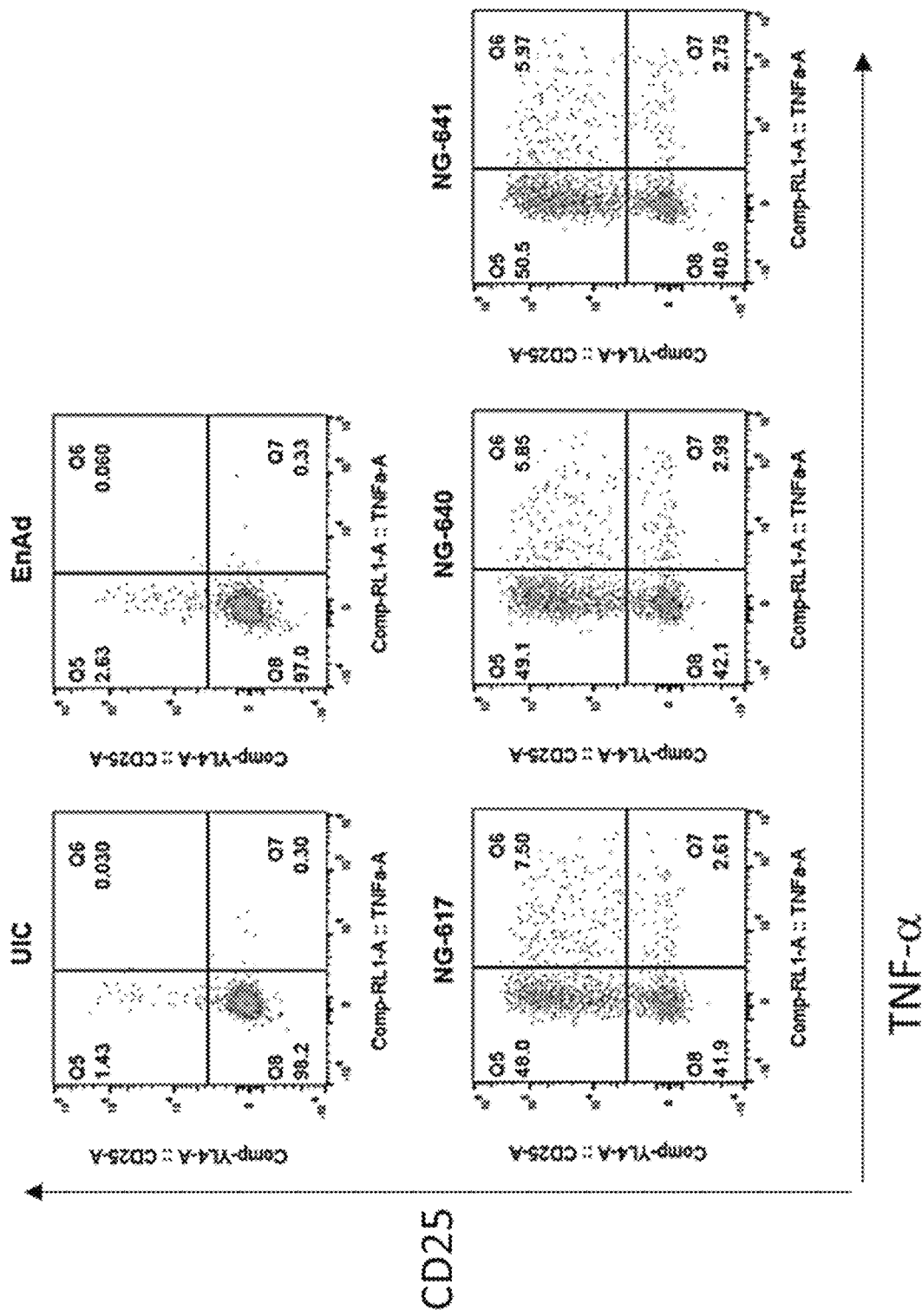
FIGURE 11D Cont. (X-axis Comp-RL1-A:TNF-a-A, Y-axis Comp-YL4-A: CD25-A)

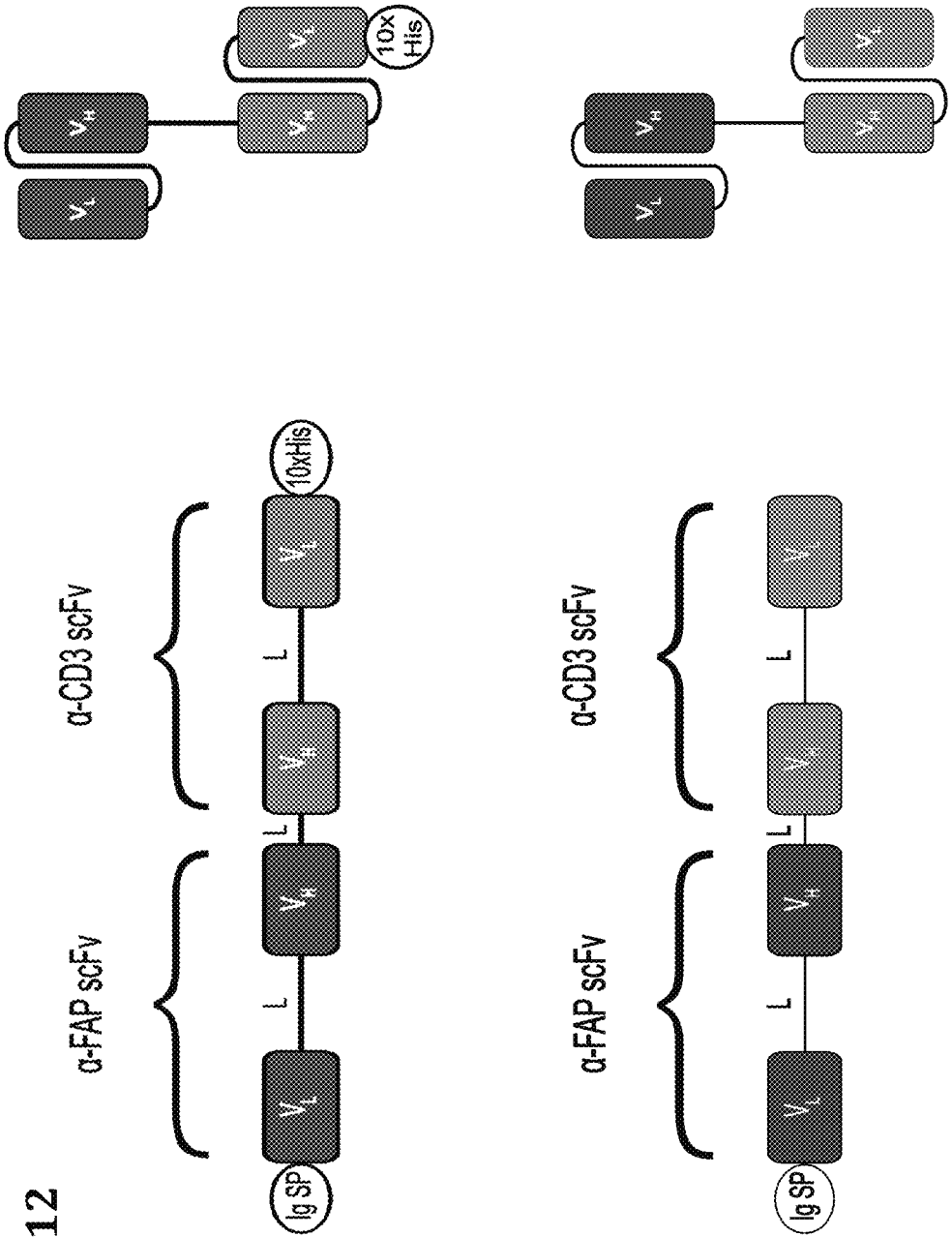

Figure 13
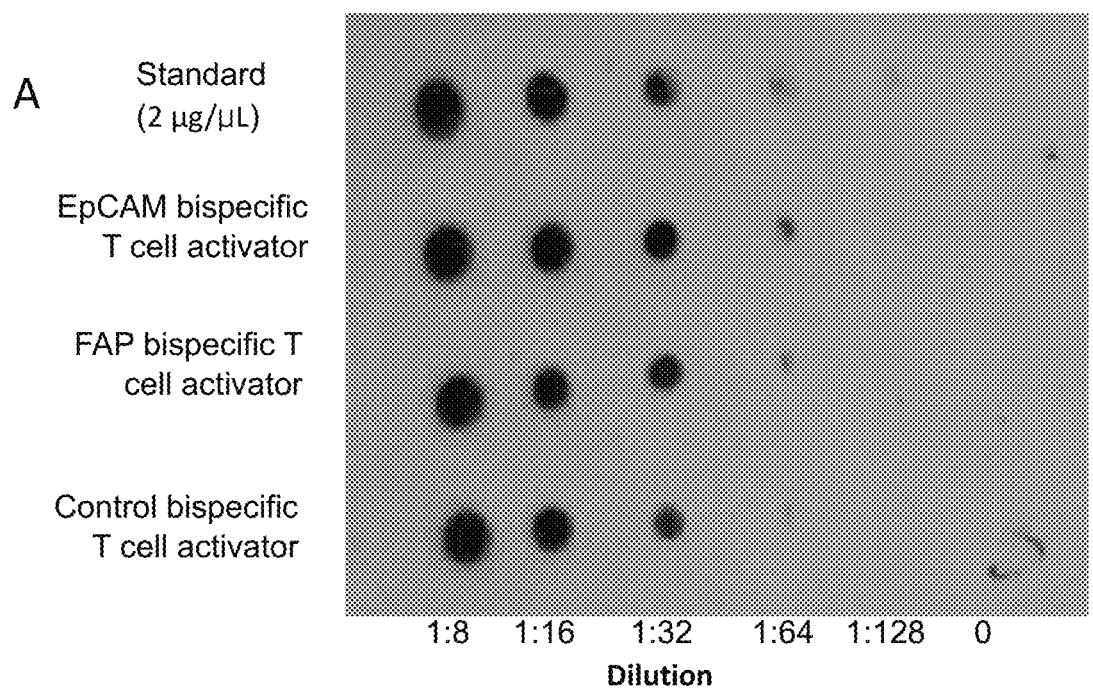
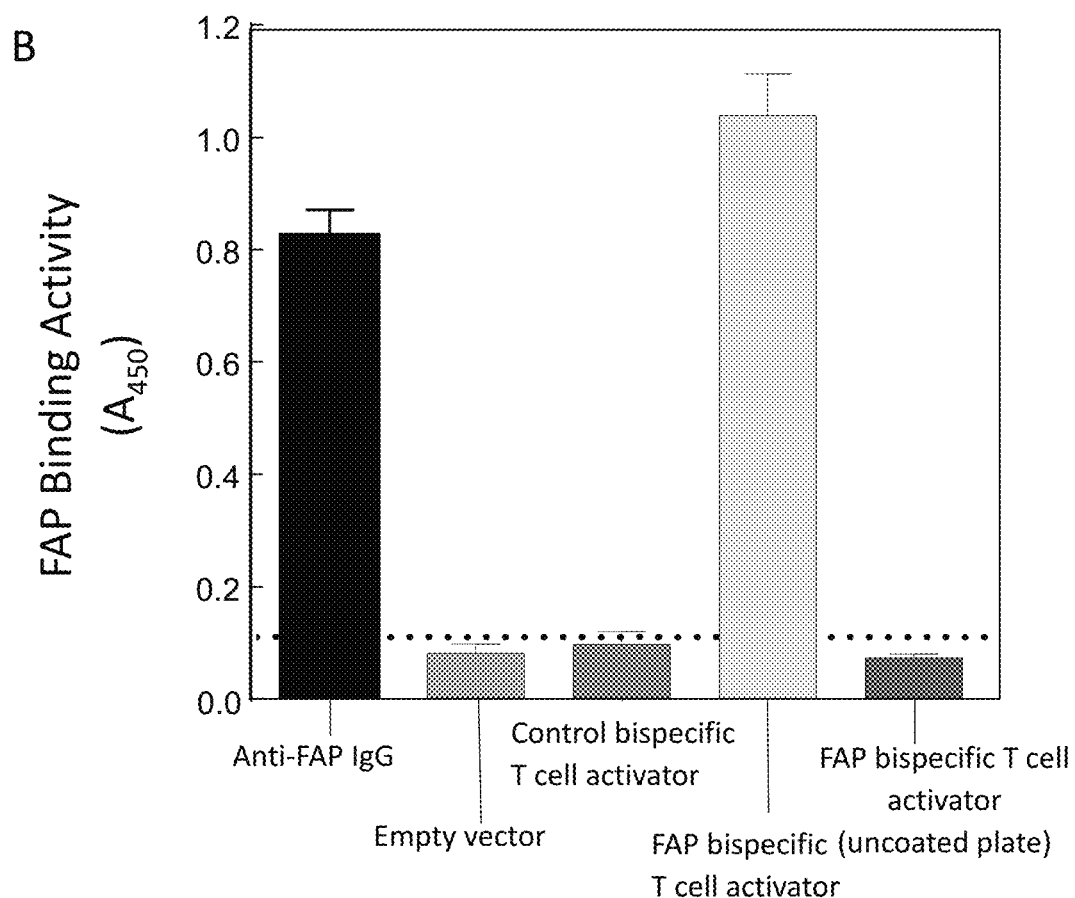

Figure 14A
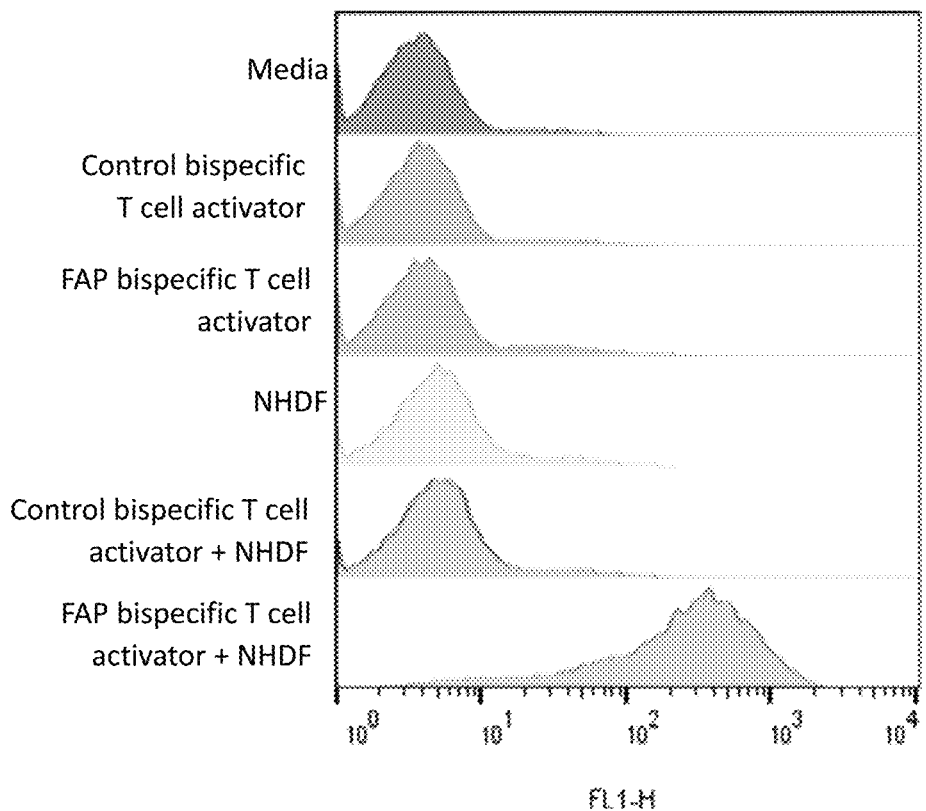
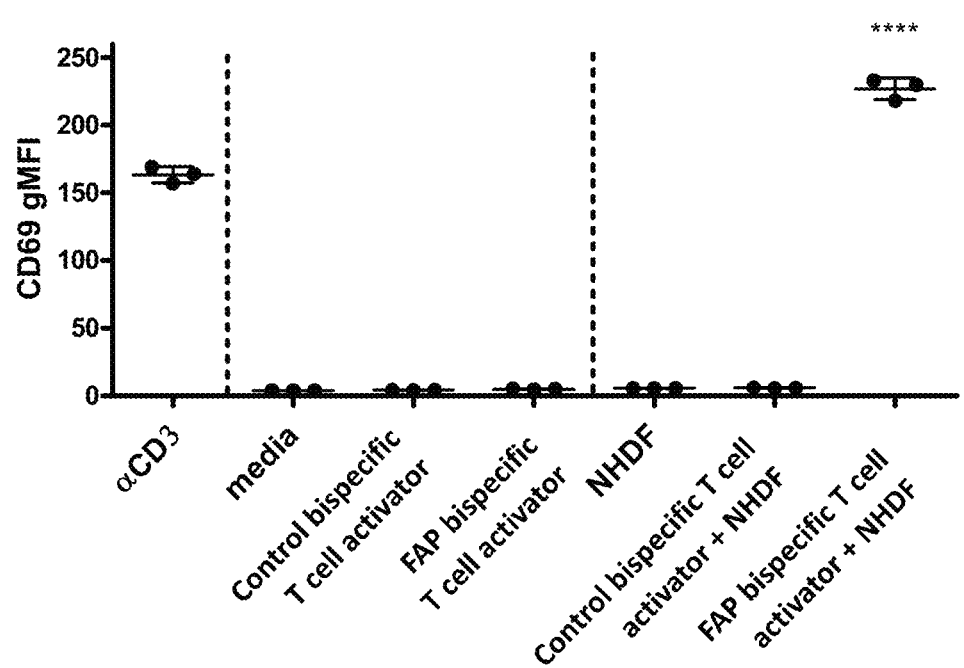

Figure 19
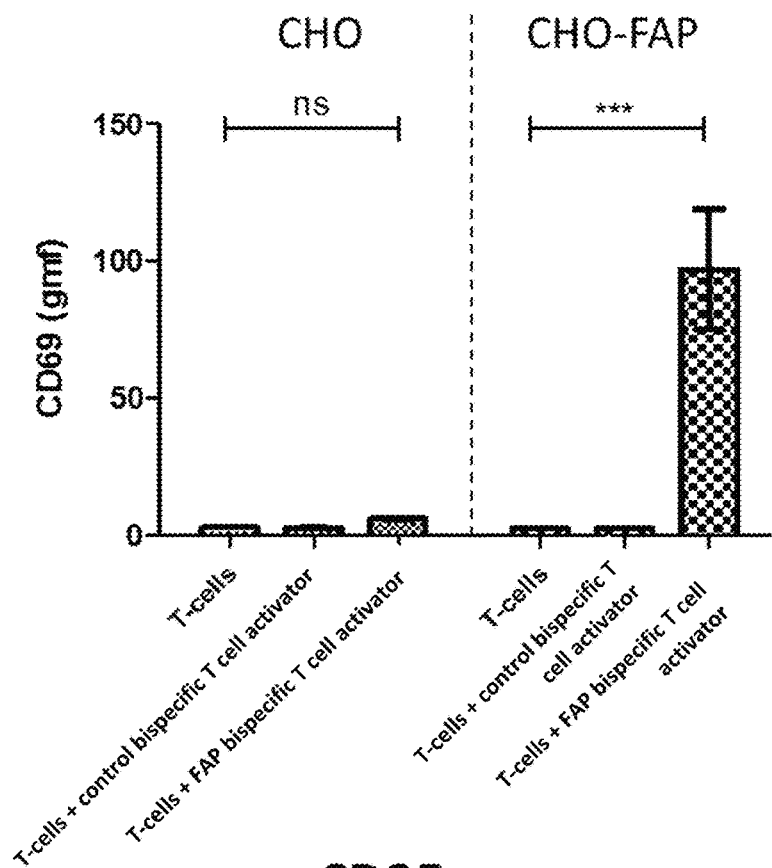
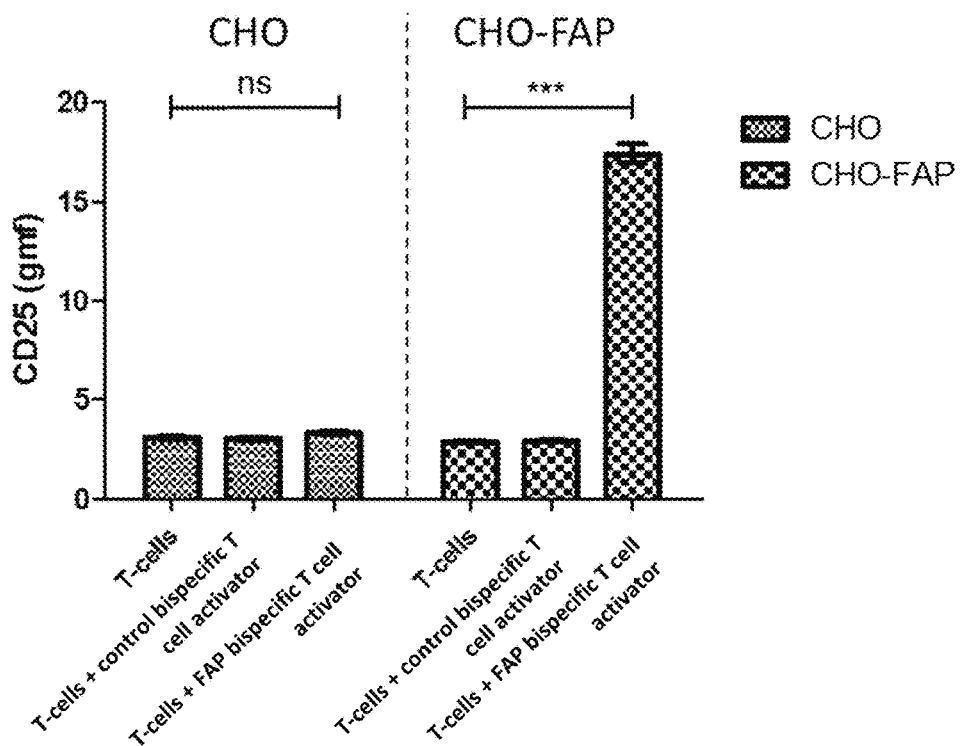

Figure 24
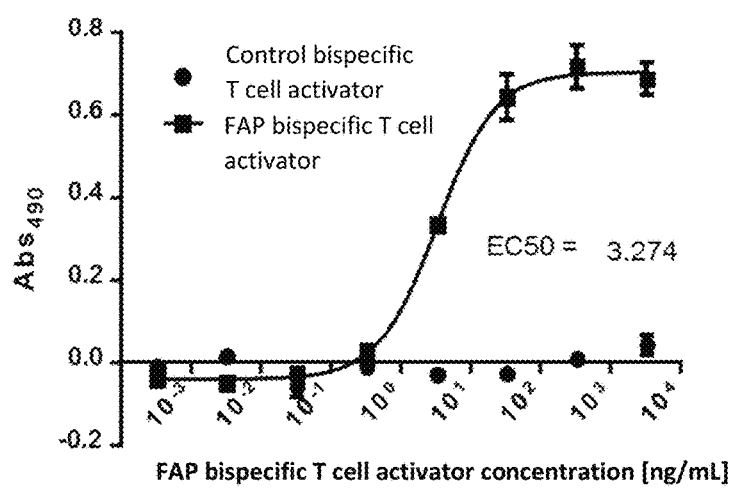
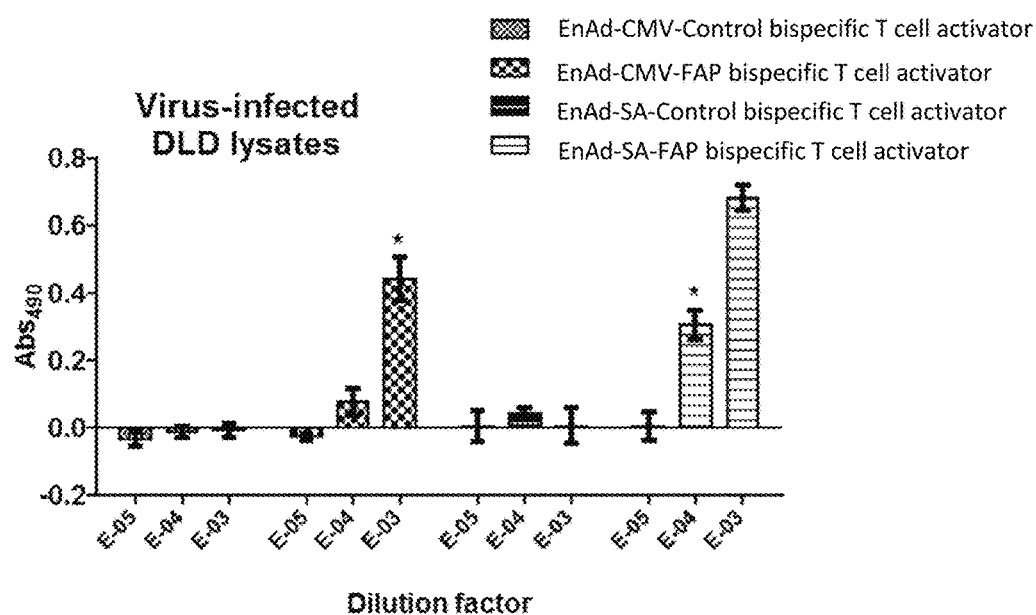
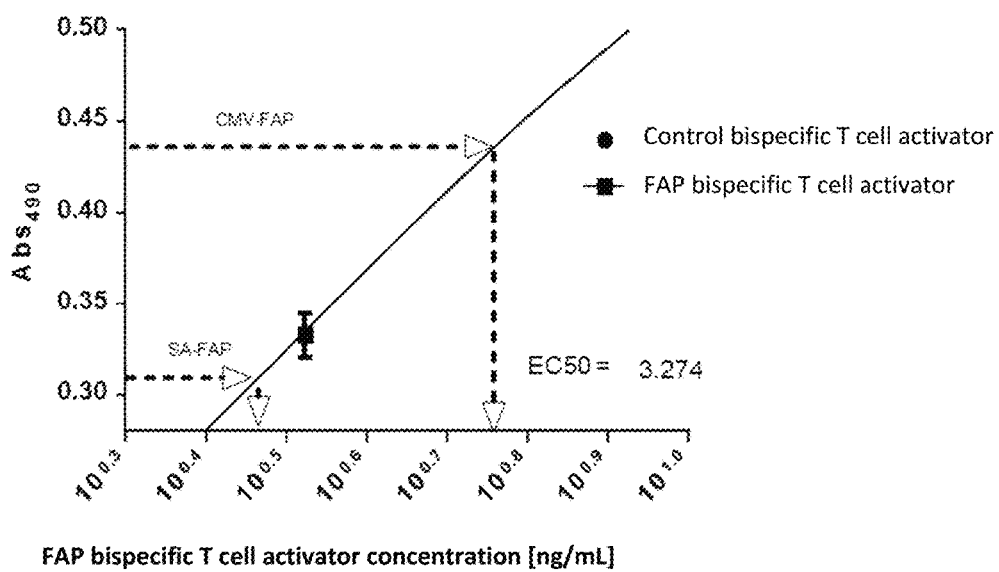

Figure 28
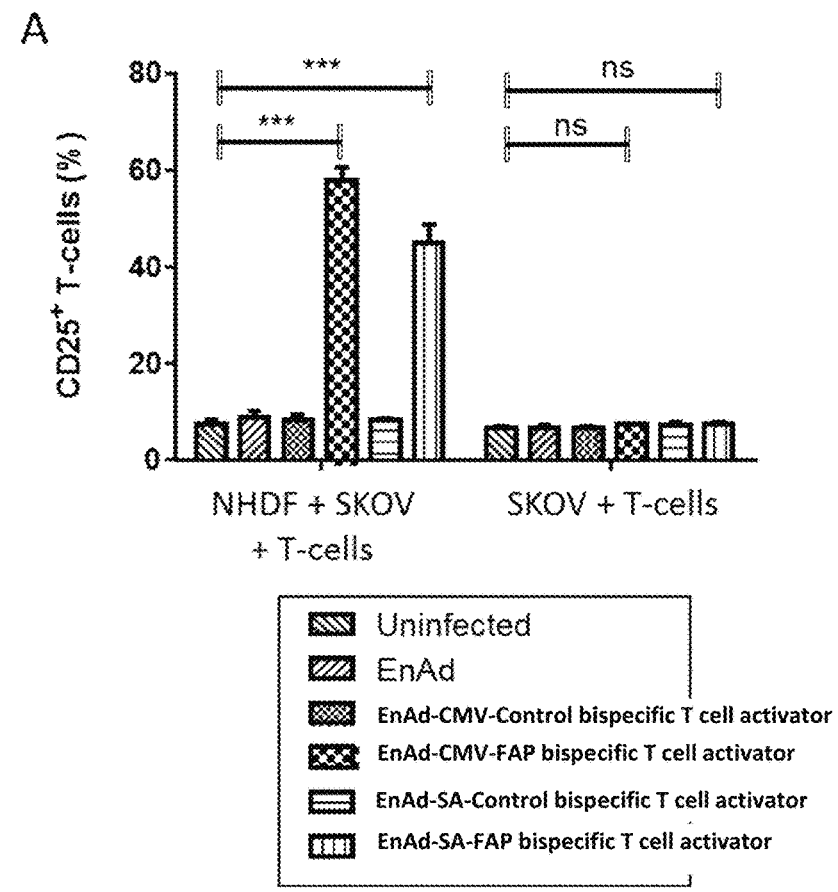
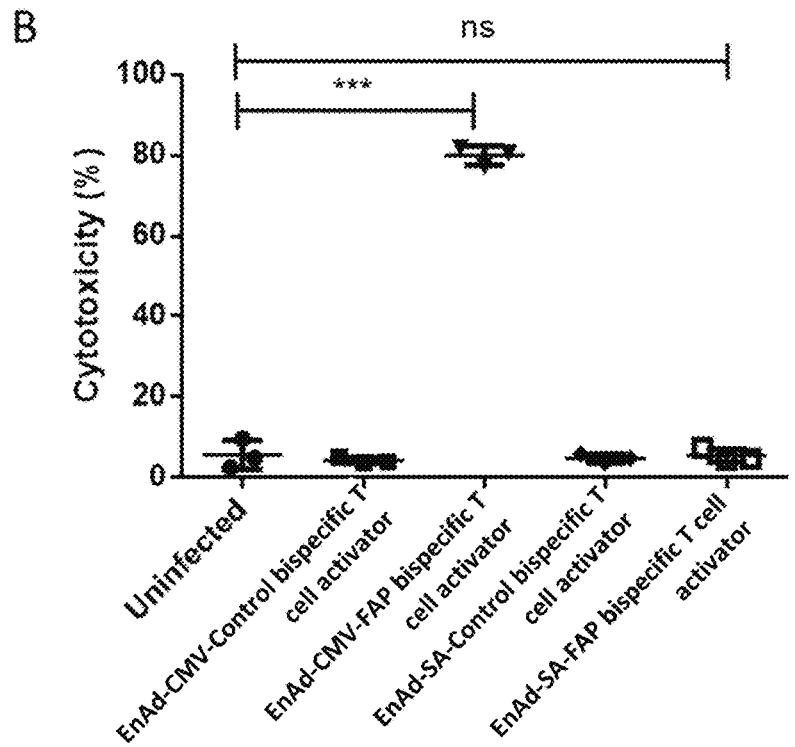

Figure 29
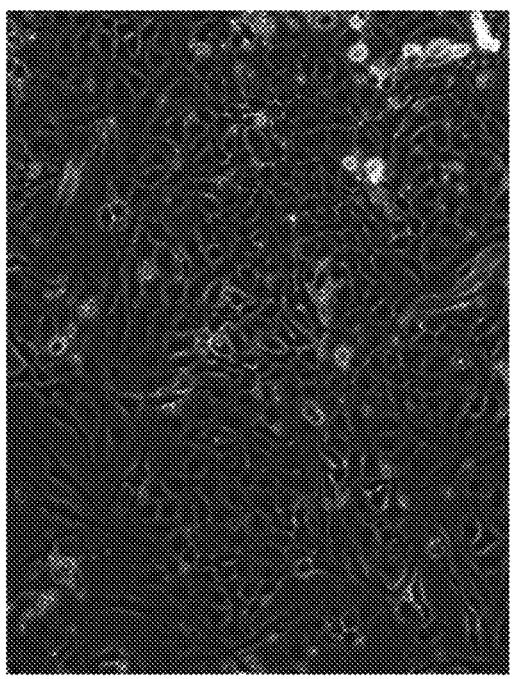
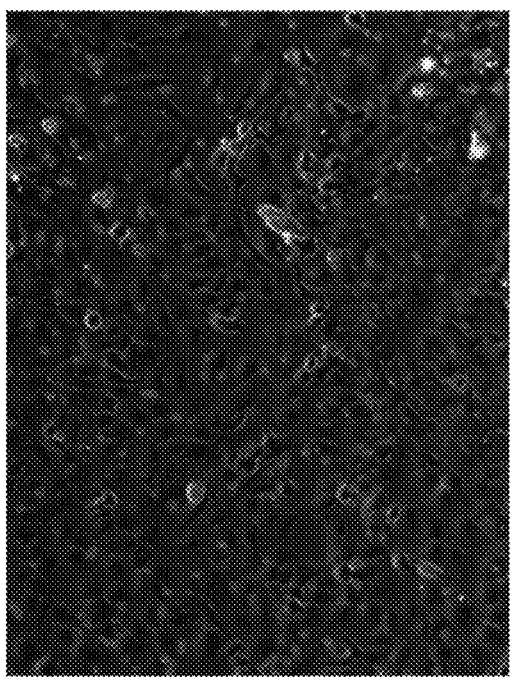
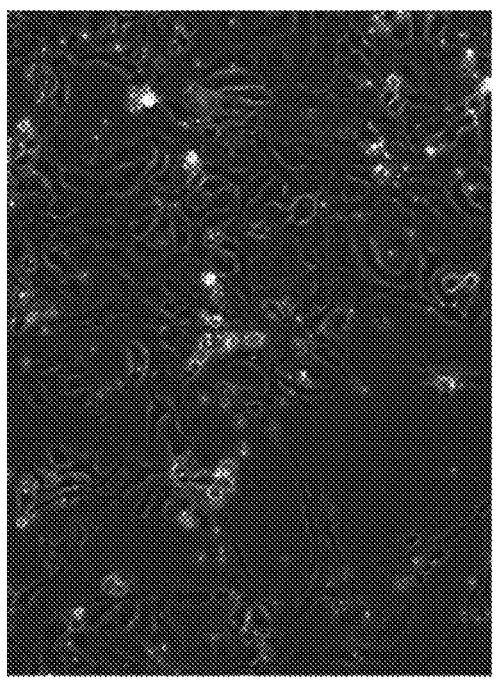
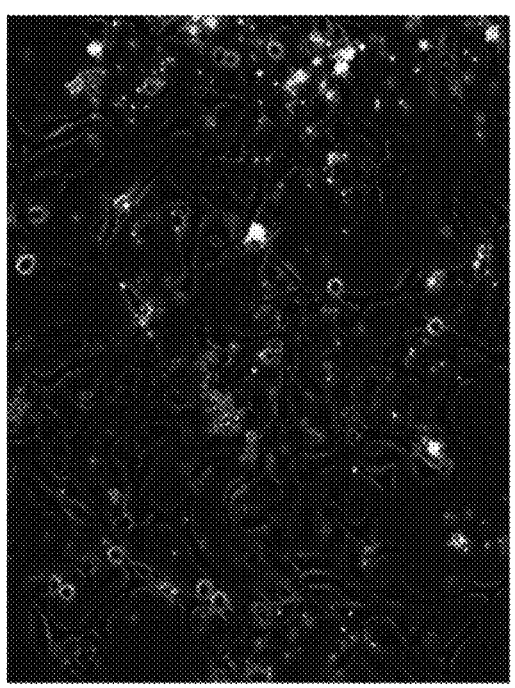
- SKOV (unstained)
- NHDF (red)
- caspase stain (green)
- Virus – 100 vp/cell

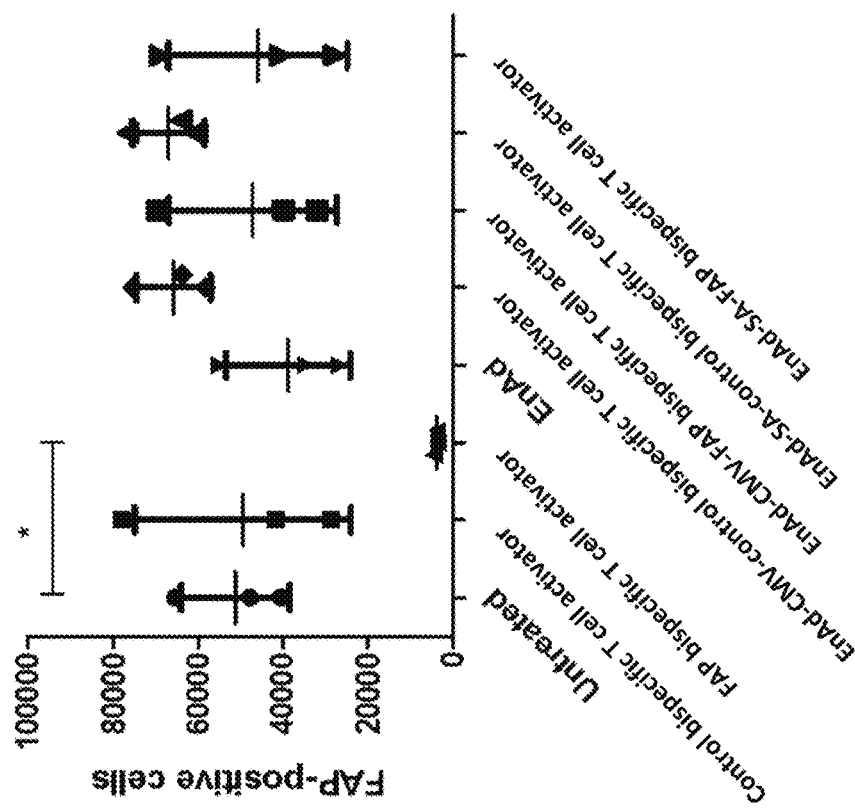
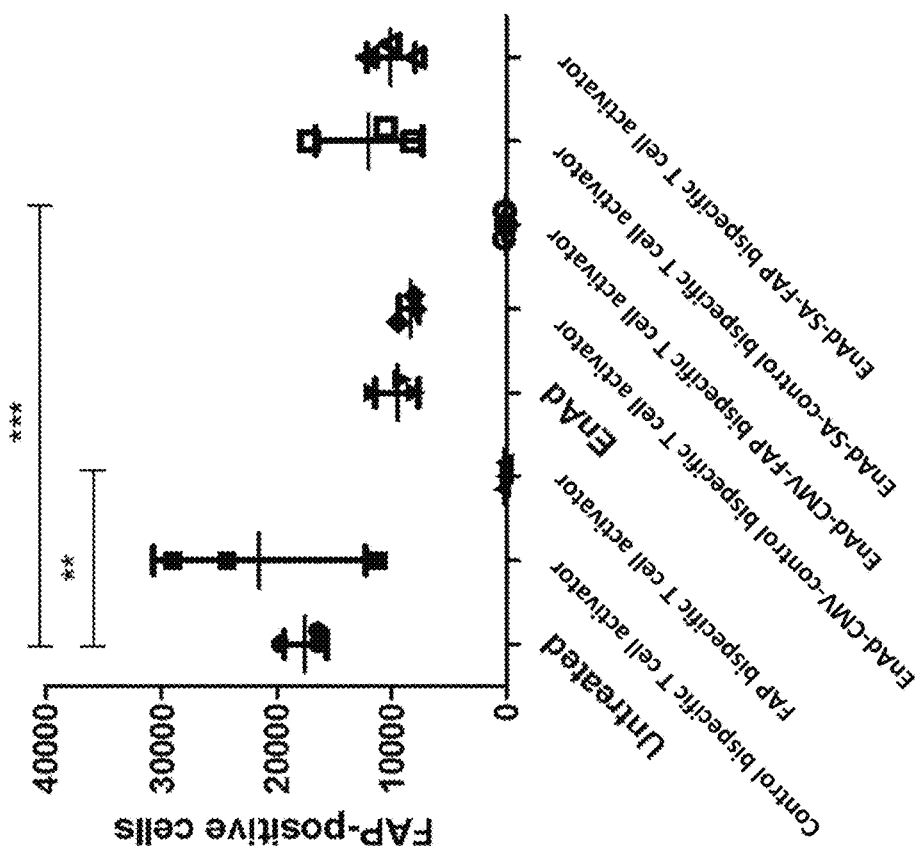
Figure 35

Figure 36
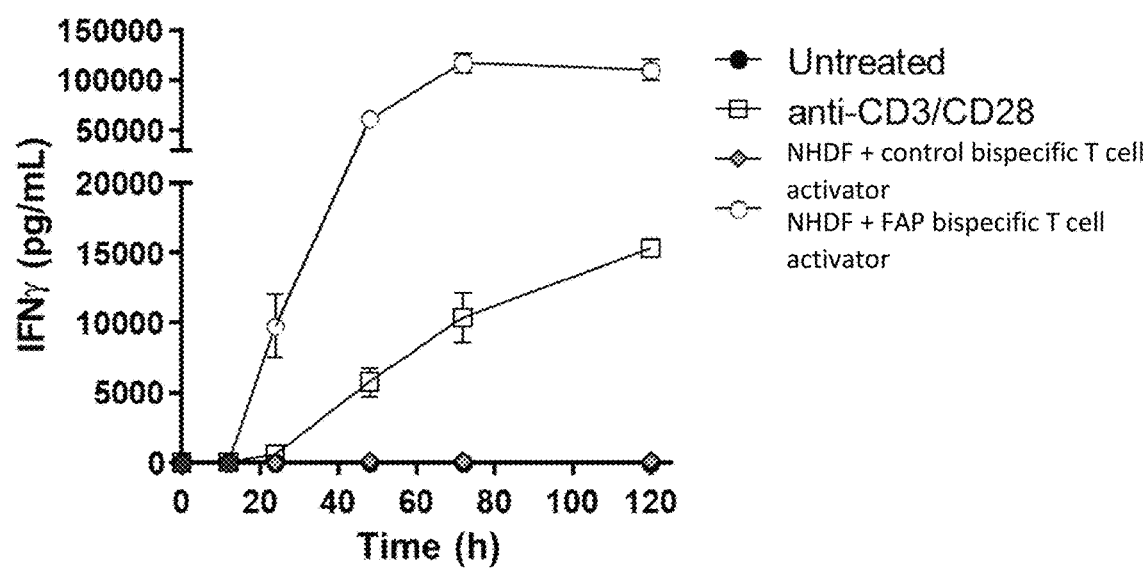
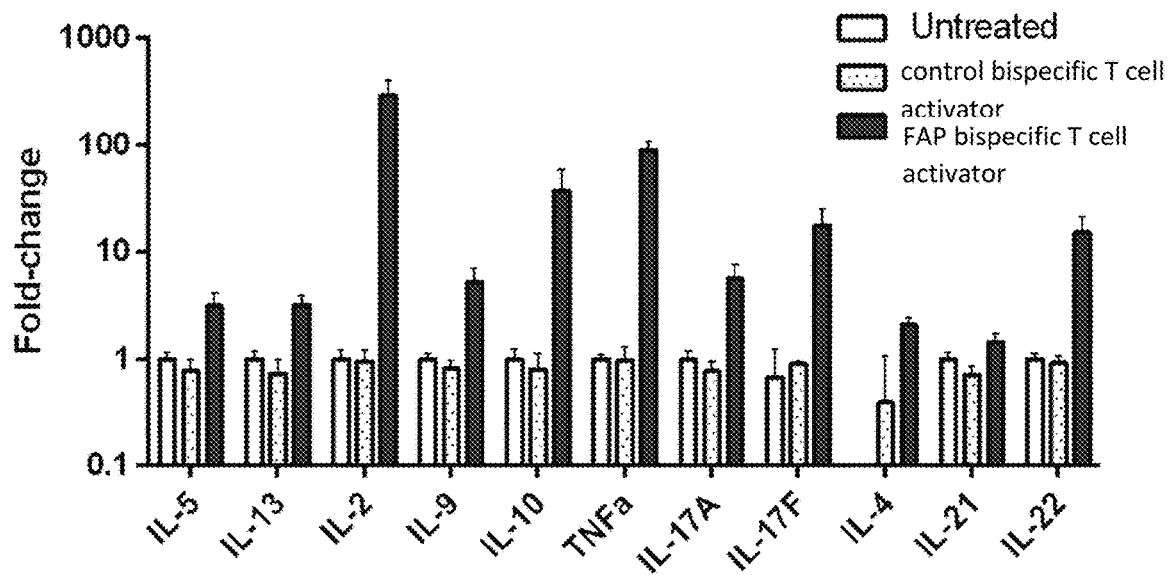

Figure 37
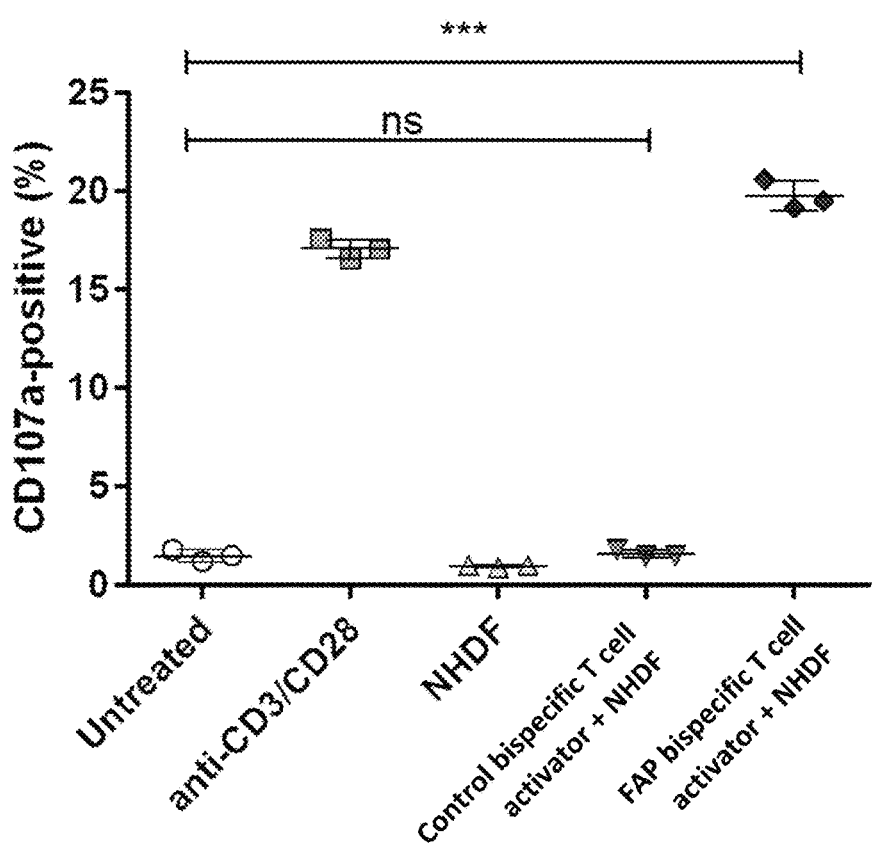
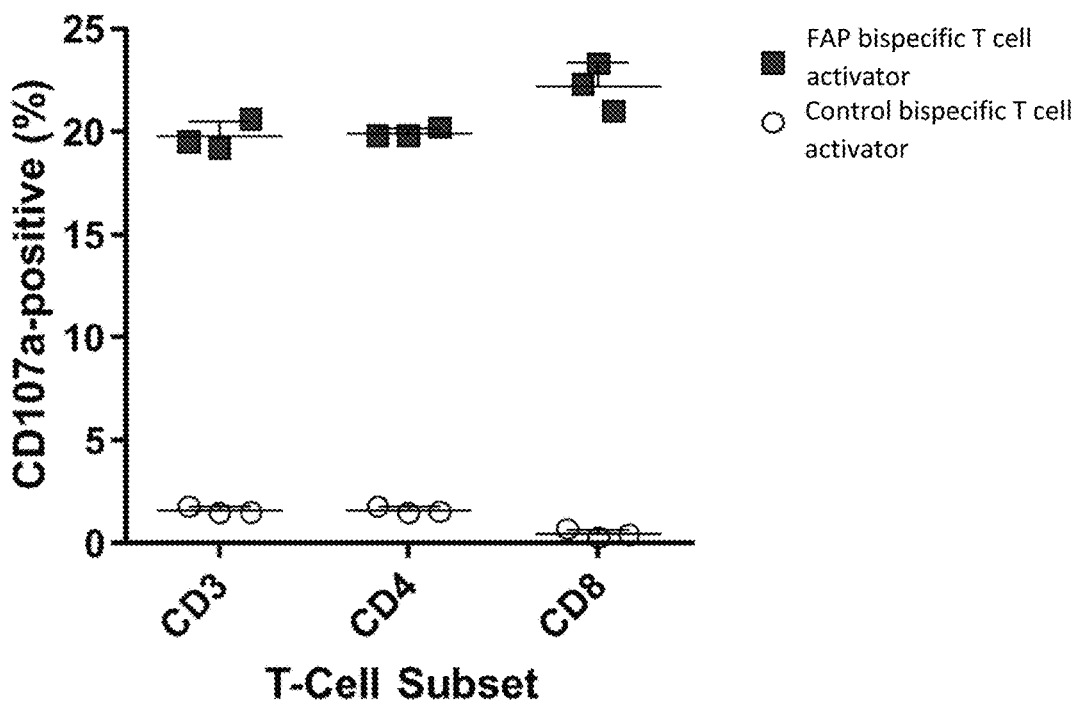

Figure 37 cont.
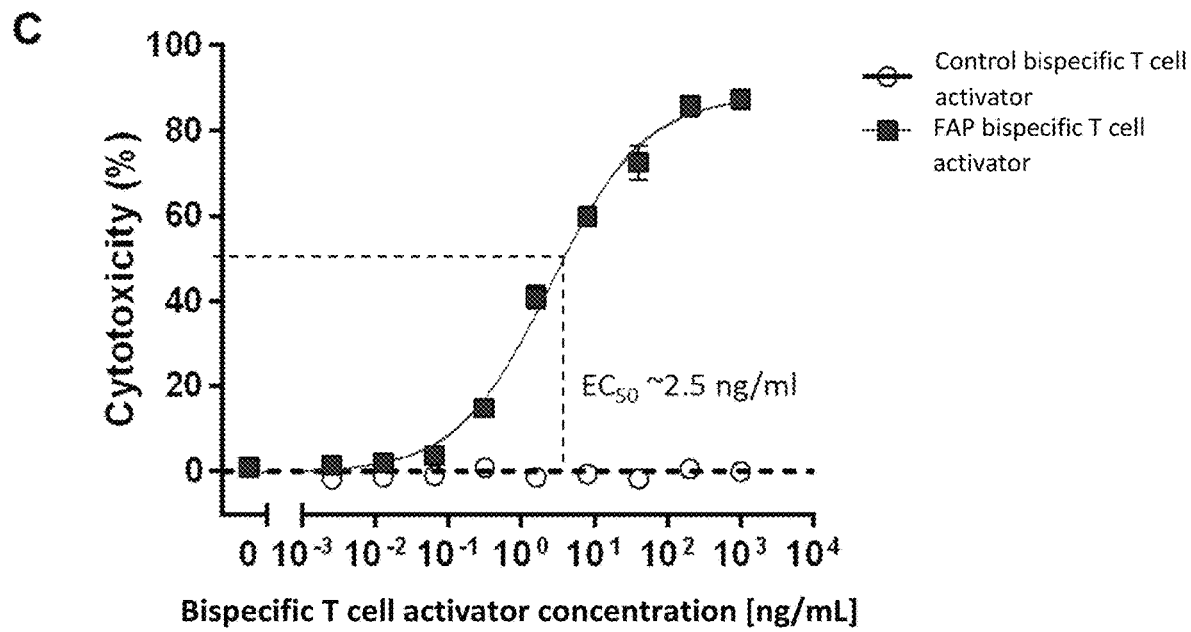
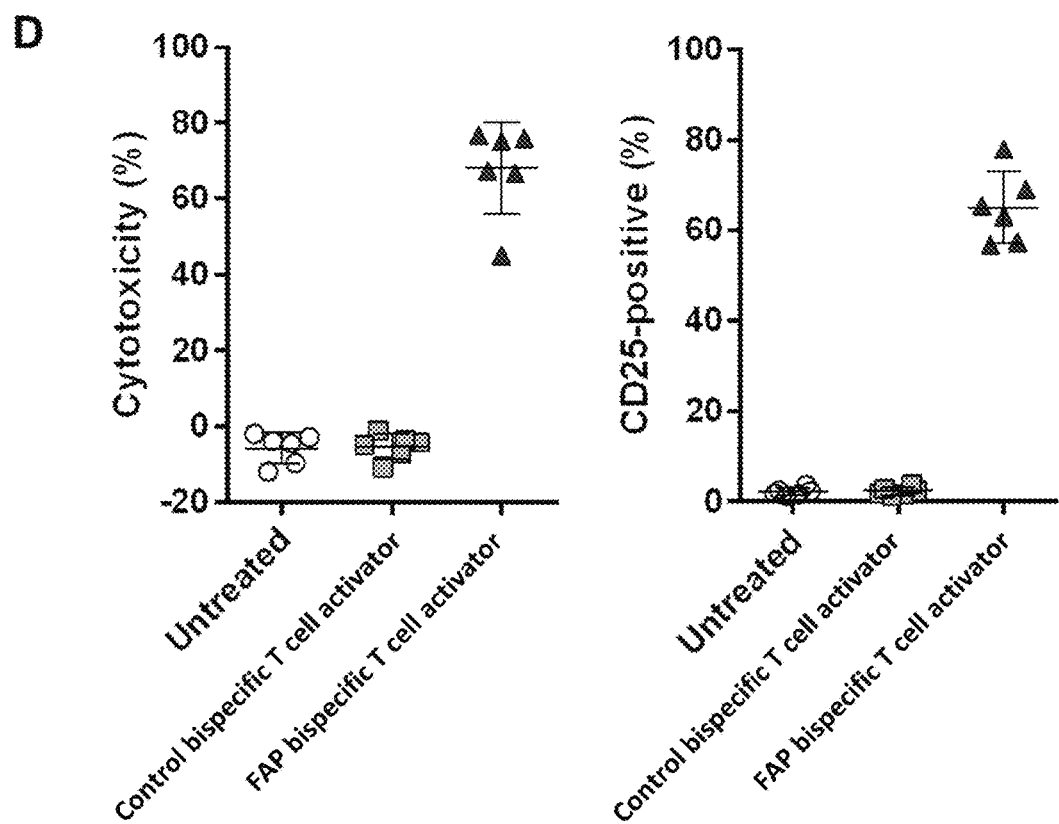

Figure 40
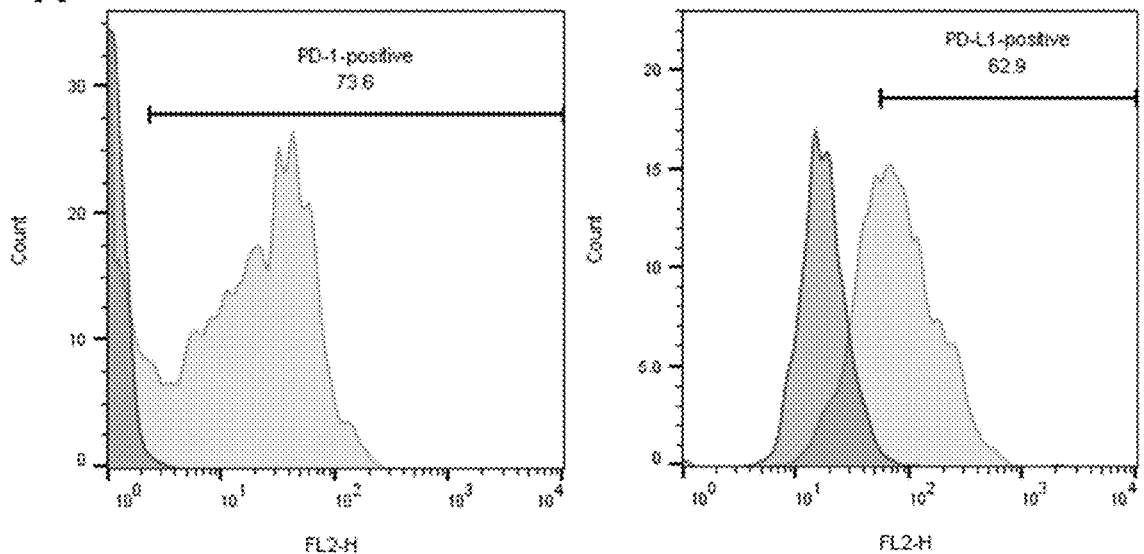
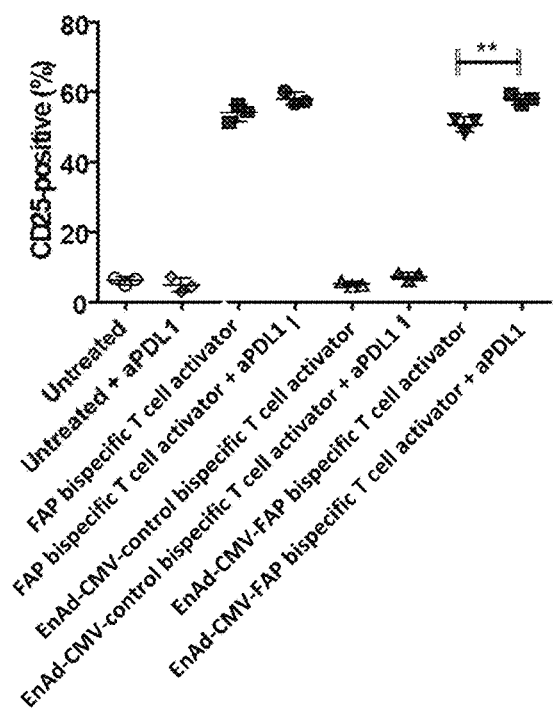
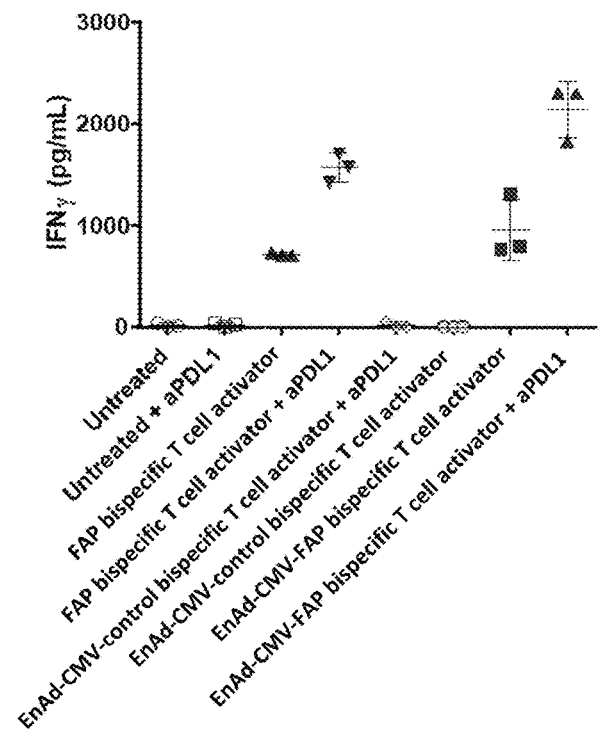

Figure 41 cont.
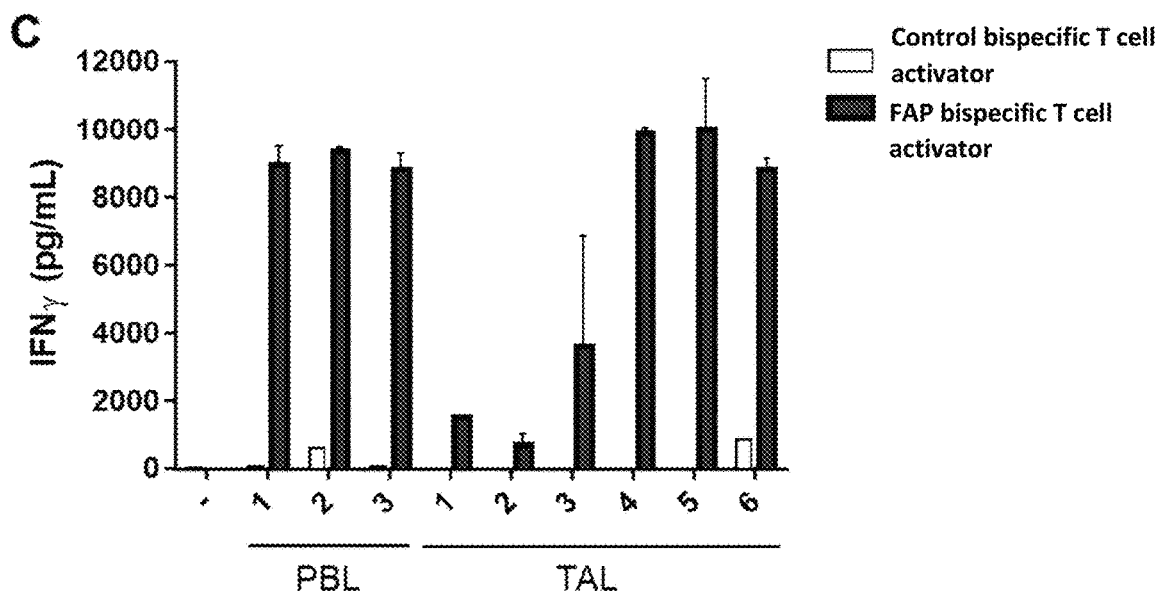
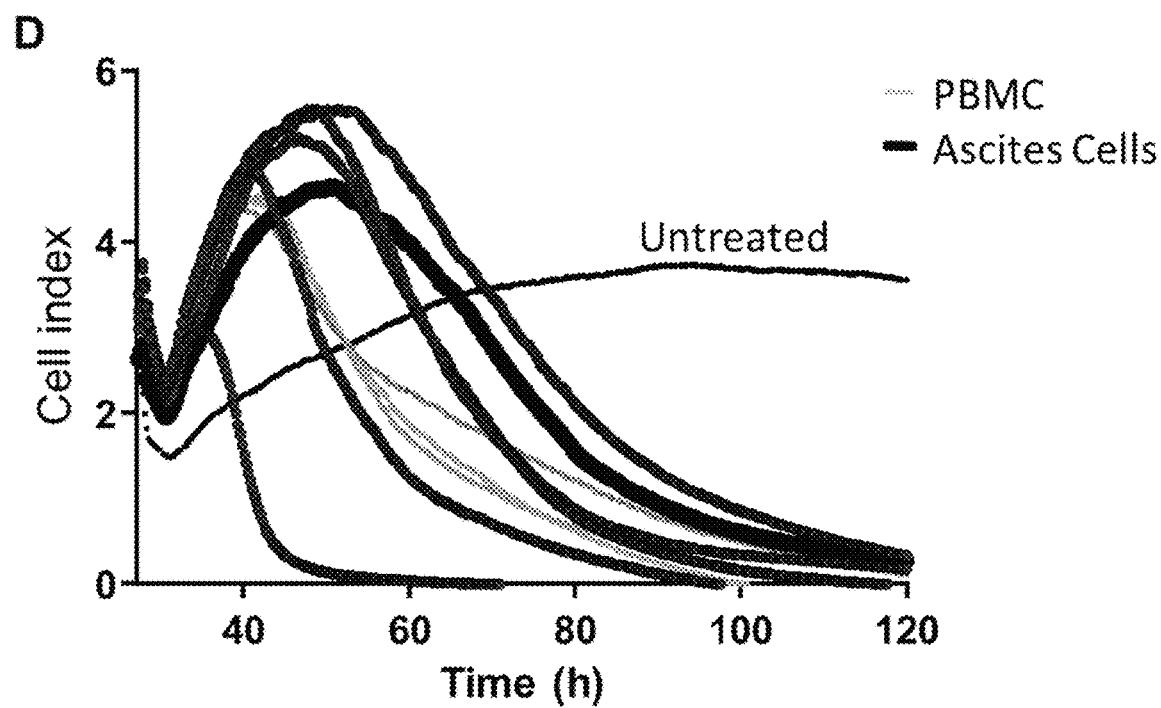

Figure 42
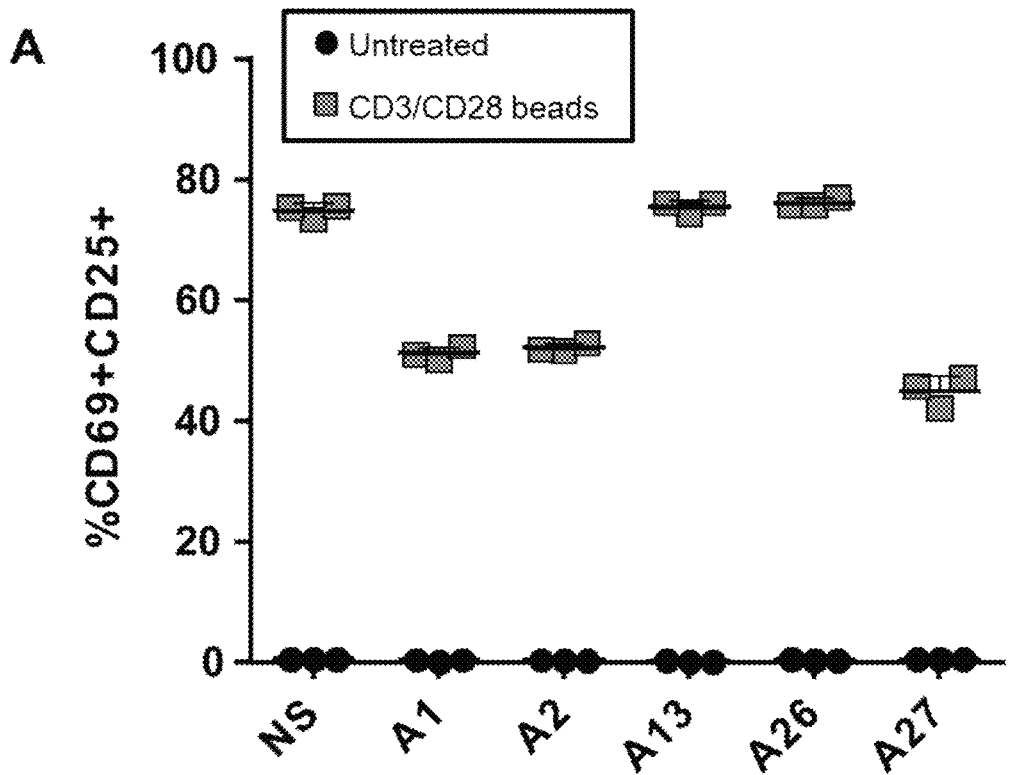
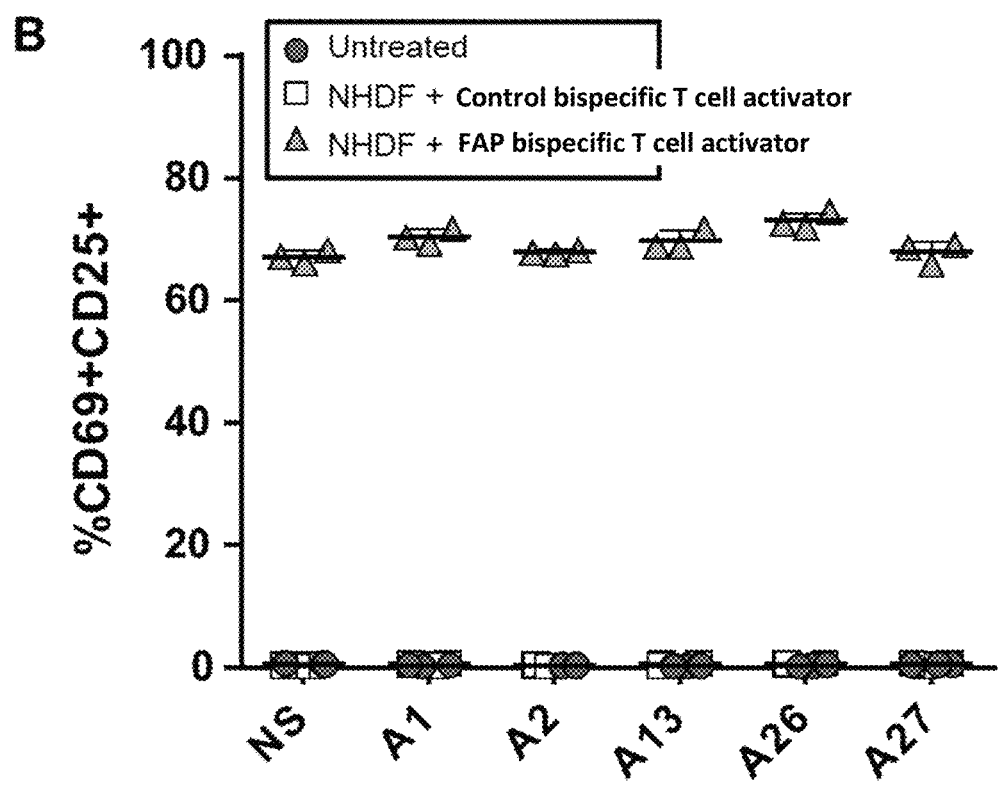

Figure 44
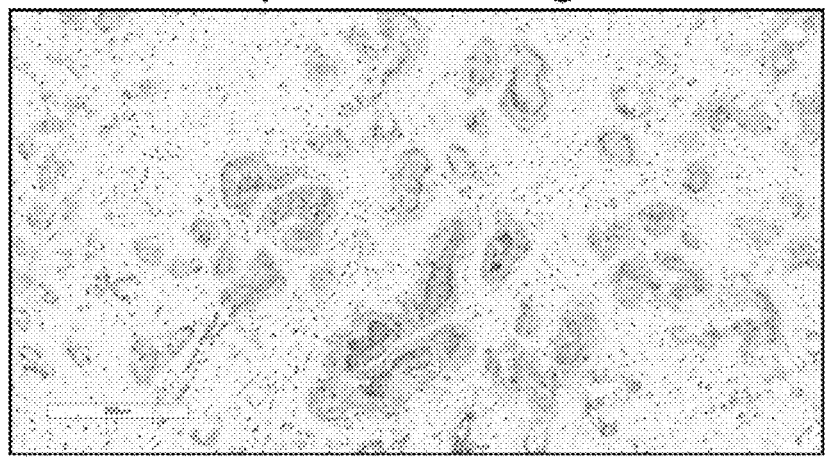
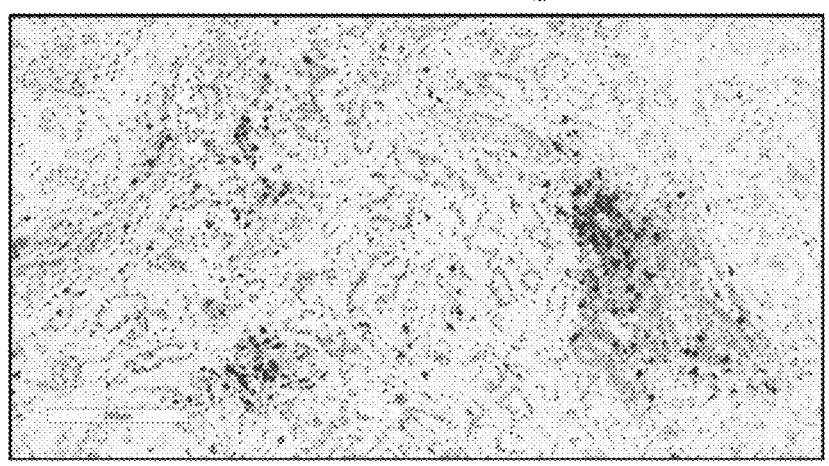
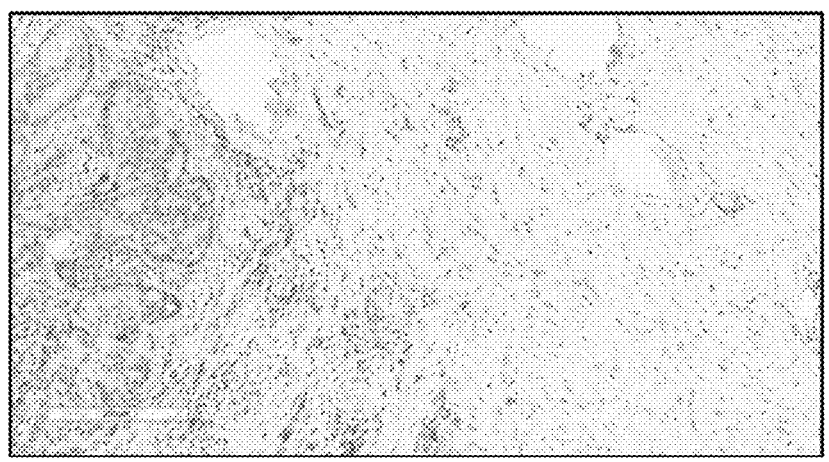

D

Figure 50A
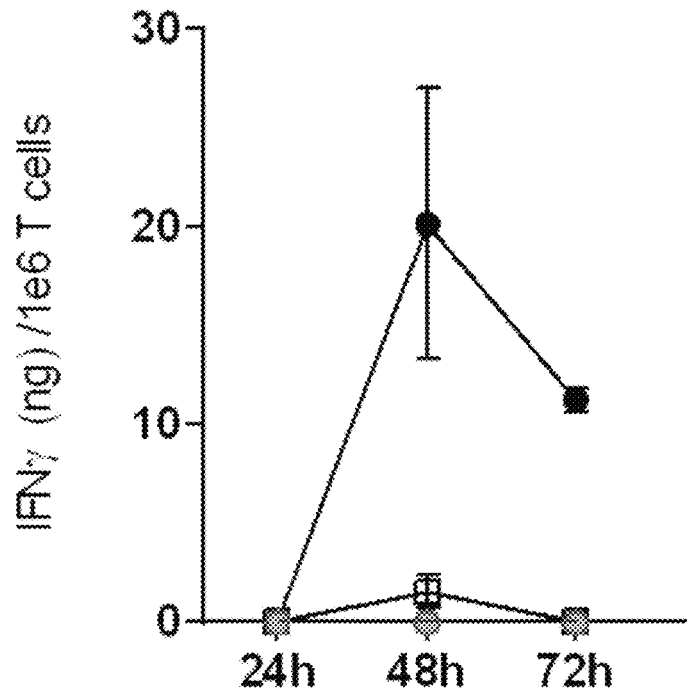
Figure 50B
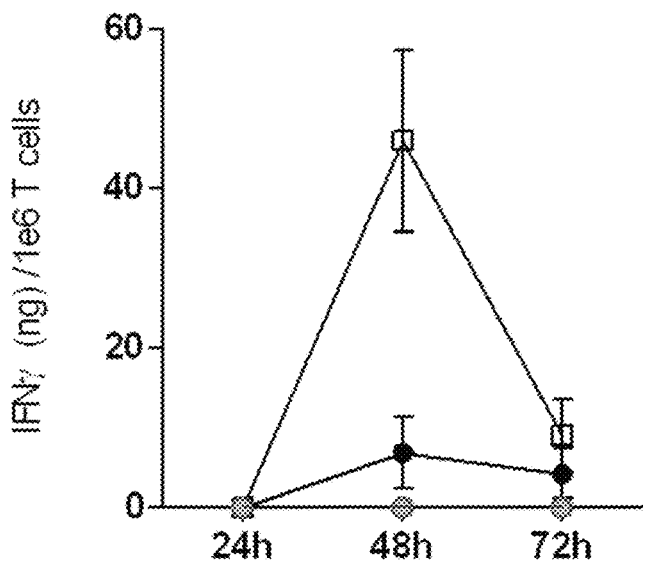
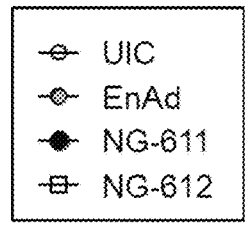

Figure 51
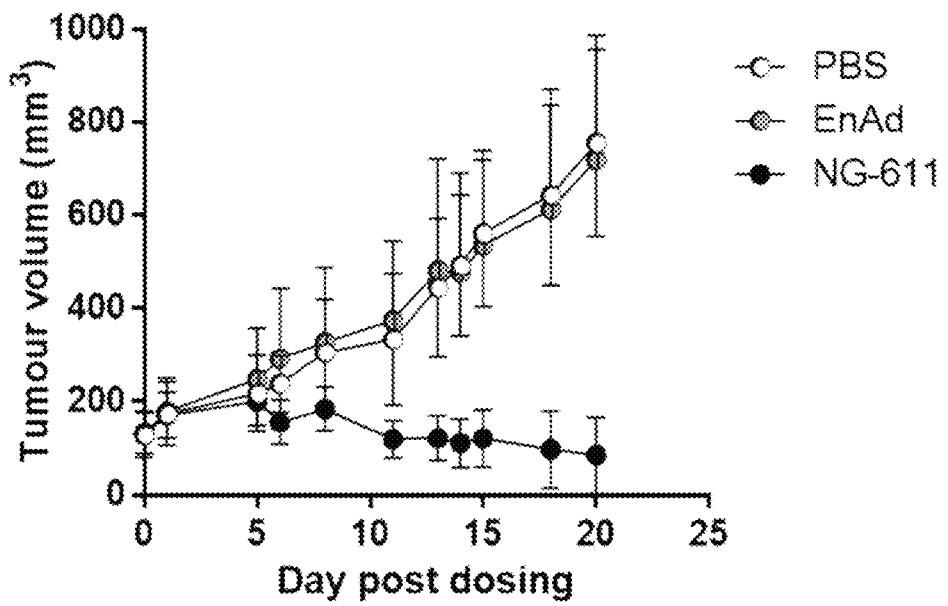
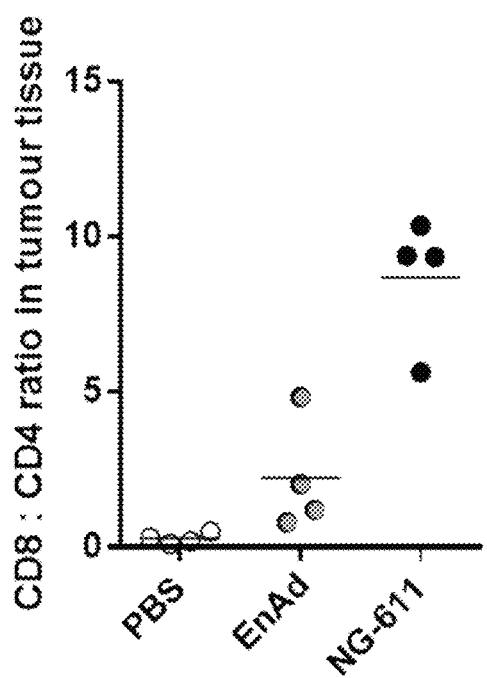

ADENOVIRUS ARMED WITH BISPECIFIC T CELL ACTIVATOR

The present disclosure relates to a modified adenovirus, in particular Enadenotucirev (EnAd), armed with a FAP-bispecific T cell activator, composition, such as a pharmaceutical formulation comprising the adenovirus, use of the virus and virus formulations, particularly in treatment, especially in the treatment of cancer. The disclosure also extends to processes for preparing the virus and DNA encoding the same. The disclosure also extends to novel sequences provide in the sequence listing in combination with the technical disclosure herein, for example wherein the virus exemplified is replaced with, for example an alternative cassette or alternative virus provided in the sequence listing.

CROSS-REFERENCE TO RELATED APPLICATIONS

The present application is a 35 U.S.C. § 371 national phase application from, and claims priority to, International Application No. PCT/EP2018/073160, filed Aug. 28, 2018, and published under PCT Article 21(2) in English, which designated the U.S., and claims the benefit of priority from United Kingdom Patent Application Nos. GB1713765.4 filed on Aug. 28, 2017 and International Application Nos. PCT/EP2017/071655 and PCT/EP2017/071674, both of which were filed Aug. 29, 2017 and each of which are incorporated by reference herein into this application in their entirety including all tables, figures and claims.

SEQUENCE LISTING

The instant application contains a Sequence Listing which has been submitted in ASCII format via EFS-Web and is hereby incorporated by reference in its entirety. Said ASCII copy, created on Nov. 10, 2022, is named 314641-00044_Sequence_Listing.txt and is 897,496 bytes in size.

BACKGROUND

Cancer is still a huge social burden to society in terms of the hardship and suffering of patients and their loved ones, and also in terms of the high financial cost of treating, caring for and supporting patients.

The stroma around the cancer cells is a physical protection in that it may have a function of trapping immune cells sent to fight the tumour. In addition, the stroma shields the hypoxic microenvironment of the tumour, which is permissive and optimised for the tumour's growth. There are some theories that cells in the stroma are a source of energy in the tumour.

A large component of tumour stroma are fibroblasts, which have been corrupted to serve the purpose of the cancer. Other cells that infiltrate the stroma are tumour associated macrophages (TAMs), which are type 2 (M2) macrophages that can promote tumour growth by secreting cytokines and chemokines, such as IL-10 that suppress immune responses.

It is especially difficult to target the tumour stroma because the cells that make up the environment are "native" immune or connective tissue cells, which are found throughout the body. Thus, targeting these cells with therapeutic agents can lead to serious off-target effects.

Hence, there is a need for an improved method of delivering a Bispecific T cell activator directly to tumour cells where it can provide maximal therapeutic benefit, in particular delivery to tumour cells surrounded by stromal fibroblasts.

WO2018/041838 and WO2018/041827 both incorporated herein by reference disclose certain adenoviruses encoding bispecific T cell activators. However, it would be useful to augment the activity of the bispecific T cell activator encoded in the virus by incorporating activating cytokines. Incorporation of two cytokines co-located with the bispecific T cell activator can achieved without much difficult. However, when three cytokines are co-located with the bispecific T cell activator the nature of the genes starts to impact on the expression of the bispecific T cell activator. The present inventors made the virus NG-615 with 4 transgenes, shown in FIG. 1. However, the expression of the bispecific T cell activator was reduced. Surprisingly the virus NG-641 wherein two of the cytokines are changed (in comparison to NG-615), the virus has good activity, including good expression of the bispecific T cell activator. Thus, it appears the four transgenes together are compatible with being co-in the virus.

The presently claimed invention relates to virus accommodating said four transgenes colocated between the fibre, L5, and the E4 region.

SUMMARY OF INVENTION

The following paragraphs are a summary of the present disclosure:

1. An adenovirus comprising a sequence of formula (I):

$$5'\text{ITR-}B_1\text{-}B_4\text{-}B_2\text{-}B_X\text{-}B_B\text{-}B_Y\text{-}B_3\text{-}3'\text{ITR} \qquad (I)$$

wherein:
  $B_1$ is a bond or comprises: E1A, E1B or E1A-E1B;
  $B_A$ comprises-E2B-L1-L2-L3-E2A-L4;
  $B_2$ is a bond or comprises: E3;
  $B_X$ is a bond or a DNA sequence comprising: a restriction site, one or more transgenes or both;
  $B_B$ comprises L5;
  $B_Y$ comprises a transgene cassette containing four transgenes, said genes encoding a FAP-bispecific T cell activator, CXL10, CXL9, and IFN;
  $B_3$ is a bond or comprises: E4.

2. An adenovirus according to paragraph 1, wherein the encoded FAP-bispecific T cell activator comprises an anti-CD3 shown in SEQ ID NO: 5 or a sequence at least 95% identical thereto, such as SEQ ID NO: 5.
3. An adenovirus according to paragraph 1 or 2 wherein the FAP-bispecific T cell activator comprises an anti-FAP shown in SEQ ID NO: 9 or a sequence at least 95% identical thereto, such as SEQ ID NO: 9
4. An adenovirus according to paragraph 1, wherein the encoded FAP-bispecific T cell activator comprises a sequence selected from SEQ ID NO: 75, SEQ ID NO: 76 or a sequence at least 95% identical to any one thereof.
5. An adenovirus according to any one of paragraphs 1 to 4, wherein the transgene cassette encodes CXL10 shown in SEQ ID NO: 100 or a sequence at least 95% identical thereto, such as SEQ ID NO: 100.
6. An adenovirus according to any one of paragraphs 1 to 5, wherein the transgene cassette encodes CXCL9 shown in SEQ ID NO: 99 or a sequence at least 95% identical thereto, such as SEQ ID NO: 99.
7. An adenovirus according to any one of paragraphs 1 to 6, wherein the transgene cassette encodes IFNα shown in SEQ ID NO: 98 or a sequence at least 95% identical thereto, such as SEQ ID NO: 98.

8. An adenovirus according to any one of paragraphs 1 to 7, wherein the transgenes are operably linked.
9. An adenovirus according to any one of paragraphs 1 to 8, wherein the transgenes are separated by 3 different high efficiency self-cleavage peptides.
10. An adenovirus according to paragraph 9, wherein the self-cleavage peptides are independently selected from E2A, F2A, P2A and T2A.
11. An adenovirus according to any one of paragraphs 1 to 10, wherein the relative order of the transgenes from L5 to E4 is FAP-bispecific T cell activator, CXL10, CXL9 and IFNα, for example as shown for NG-641 in FIG. 1.
12. An adenovirus according to any one of paragraphs 1 to 11, wherein the transgene cassette has a polynucleotide sequence shown in SEQ ID NO: 95 or a polynucleotide encoding the same amino acid sequence, in particular SEQ ID NO: 95.
13. An adenovirus according to any one of paragraphs 1 to 12, wherein the adenovirus comprises SEQ ID NO: 84.
14. An adenovirus according to any one of paragraphs 1 to 13, wherein the adenovirus is replication competent.
15. An adenovirus according to any one of paragraphs 1 to 14, wherein the adenovirus is oncolytic.
16. An adenovirus according to any one of paragraphs 1 to 15, wherein the virus has a hexon and fibre from Ad11.
17. A pharmaceutical composition comprising an adenovirus according to any one of paragraphs 1 to 16 and an excipient, diluent or carrier.
18. An adenovirus according to any one of paragraphs 1 to 16, or a pharmaceutical composition according to paragraph 17, for use in treatment, for example for use in the treatment of cancer.
19. A method of treating a patient comprising administering an adenovirus according to any one of paragraphs 1 to 16 or a pharmaceutical composition according to paragraph 17.
20. Use an adenovirus according to any one of paragraphs 1 to 16, or a pharmaceutical composition according to paragraph 17, for the manufacture of a medicament for the treatment of cancer.

In one embodiment the Bispecific T cell activator or Bispecific T cell activators of according to the present disclosure do not comprise a transmembrane domain and so are not expressed on the cancer cell surface but rather comprises a signal sequence to facilitate release of the Bispecific T cell activator molecule from the cancer cell infected by the virus.

In one embodiment the transgene cassette is under the control of an endogenous promoter, for example the major later promoter.

Advantageously, the present inventors have discovered that arming an adenovirus with a Bispecific T cell activator molecule allows the bi-specific antibody fragment molecule to 'piggyback' on the ability of the adenovirus to selectively infect cancer cells, thereby enabling the targeted delivery of the Bispecific T cell activator to tumour cells.

Advantageously, Bispecific T cell activators are small and can be made in mammalian cells. Hence once infected by the adenoviruses of the present disclosure, the Bispecific T cell activator molecules are synthesized by tumour cells, secreted and can act locally, spreading beyond the immediate footprint of the virus. This therefore allows the Bispecific T cell activator to spread beyond the immediate site of infection but at the same time limits the spread of the virus too far beyond the infected tumour cell site. This minimises the risk of undesired off-target effects.

In one embodiment, the adenovirus is EnAd. EnAd has been shown to have an enhanced oncolytic activity compared to other adenovirus platforms, for example based on Ad5. EnAd has also been shown to have a high selectivity for human epithelial-derived carcinoma cells, such as colon, lung, bladder and renal cancer cells. This makes it an ideal delivery vehicle for Bispecific T cell activator molecules because T-cells can be activated by the Bispecific T cell activator molecule to attack target cells whilst EnAd simultaneously infects and lyses cancer cells. This results in a two-pronged attack on the tumour which has a synergistic oncolytic effect.

In one embodiment the anti-CD3 component of the Bispecific T cell activator is selective for an antigen selected from CD3ε, CD3γ and CD3δ, in particular CD3ε.

FAP is a tumour stroma antigen. Advantageously, stromal cells (non-transformed cells) expressing these antigens are not subjected to the same level of mutation-resistance-selection process as transformed cells. Therefore, these cells are easier to target for cancer therapy since they are not a 'moving target'. Furthermore, the types of receptors found in stromal cells are often common across different types of cancer. Hence, targeting FAP is likely to be effective for multiple cancer types.

Advantageously, FAP is upregulated on tumour associated fibroblasts. Fibroblasts are a vital component of solid carcinomas supporting growth, invasion and recovery from interventions. They typically comprise 40-60% of the cells in advanced carcinomas. Advantageously, fibroblasts are genetically stable cells that are less likely to escape therapy than cancers cells. Activated fibroblasts are also relatively similar across a variety of tumour types. Thus, by activating T cells to target and kill FAP expressing tumour associated fibroblasts, the adenoviruses of the present disclosure can help to diminish a spectrum of immune suppressive pathways, such as those mediated by IL-10, TGFβ and ID0.

In one embodiment $B_X$ is not a bond.

In one embodiment the adenovirus is chimeric. In one embodiment the adenovirus is oncolytic. In one embodiment the adenovirus is chimeric and oncolytic. In one embodiment the adenovirus replication capable. In one embodiment the adenovirus is chimeric, oncolytic and replication capable. In one embodiment the adenovirus is replication competent. In another embodiment the adenovirus is chimeric, oncolytic and replication competent. In one embodiment the adenovirus is replication deficient, i.e. is a vector.

In one embodiment $B_X$ comprises a transgene or transgene cassette, in particular a transgene cassette encoding a Bispecific T cell activator. In one embodiment the further transgene is under the control of an exogenous promoter, such as a CMV promoter.l Employing an exogenous promoter may be advantageous in some embodiments because it can strongly and constitutively express the antibody or fragment, which may be particularly useful in some situations, for example where the patient has very pervasive cancer. Advantageously, the use of a constitutive exogenous promoter results in continuous transcription of the transgene which may be desirable in certain instances.

In one embodiment the transgene cassette, comprises a Kozak sequence, for example at the start of the coding sequence, in particular at the L5 end of the transgene cassette.

In one embodiment the transgene cassette further comprises a polyadenylation sequence, for example at the end of the sequence, in particular at the E4 region end of the transgene cassette.

In one embodiment the transgene cassette has the arrangement shown in FIG. 1, such as virus NG-641.

In one embodiment the Bispecific T cell activator molecule has short half-life, for example 48 hours or less.

In one embodiment the adenovirus only contains one Bispecific T cell activator.

In another embodiment the adenovirus contains two Bispecific T cell activators.

In one embodiment the FAP-Bispecific T cell activator comprises a VH domain comprising an amino acid sequence as set forth in SEQ ID NO: 11, or an amino acid sequence that is at least 95% identical thereto.

In one embodiment the FAP-Bispecific T cell activator comprises a VL domain comprising an amino acid sequence set forth in SEQ ID NO: 10, or an amino acid sequence that is at least 95% identical thereto.

In one embodiment the anti-CD3 portion of the FAP-Bispecific T cell activator comprises a VH domain comprising an amino acid sequence set forth in SEQ ID NO: 6, or an amino acid sequence that is at least 95% identical thereto.

In one embodiment the anti-CD3 portion of the FAP-Bispecific T cell activator comprises a VL domain comprising an amino acid sequence set forth in SEQ ID NO: 7, or an amino acid sequence that is at least 95% identical thereto.

In one embodiment the adenovirus according to the present disclosure comprises a sequence set forth in SEQ ID NO: 34 or 35, or a polynucleotide encoding the same scFv amino acid sequence, in particular SEQ ID NO: 34.

In one embodiment the adenovirus according to the present disclosure comprises a sequence set forth in SEQ ID NO: 68, SEQ ID NO: 69 or a polynucleotide sequence encoding the same amino acid sequence.

In one embodiment the adenovirus according to the present disclosure comprises a sequence set forth in SEQ ID NO: 90 or a polynucleotide encoding the same amino acid sequence.

In one embodiment the adenovirus according to the present disclosure comprises a sequence set forth in SEQ ID NO: 91 or a polynucleotide encoding the same amino acid sequence.

In one embodiment the adenovirus according to the present disclosure comprises a sequence set forth in SEQ ID NO: 92 or a polynucleotide encoding the same amino acid sequence.

The skilled person is aware that there is redundancy in the DNA code, thus the present disclosure extends to EnAd or Ad11 encoding a Bispecific T cell activator with an amino acid disclosed herein.

A C-terminal His affinity tag (such as a deca or hexa-his tag) is useful for purification of the Bispecific T cell activator or adenovirus. However, it is optional and may be excluded for example in the end product. The skilled person is aware that other affinity tags other than deca-His can be used and likewise may be excluded without affecting the biological function of the Bispecific T cell activator or adenovirus.

Accordingly, in one embodiment the Bispecific T cell activator comprises an amino acid sequence as set forth in SEQ ID NO: 1 or 2 but excludes the His affinity tag at the C-terminal end of the sequence, such as SEQ ID NO: 61 or 62.

The exclusion of the deca-His affinity tag further extends to all other sequences disclosed herein comprising the deca-His affinity tag, i.e. the present disclosure includes the same amino acid or DNA sequences lacking the C-terminal His tag.

In one aspect there is provided a composition comprising an adenovirus as described herein and a diluent or carrier.

In one aspect, there is provided a method of treating a patient comprising administering a therapeutically effective amount of an adenovirus or a composition as described herein.

In one embodiment the method is for the treatment of cancer, for example an epithelial cancer, in particular a solid tumour.

In one embodiment there is provide a method of treatment comprising administering a virus according to the present disclosure in combination with a checkpoint inhibitor (such as a PD-1 or PDL1 inhibitor), in particular wherein the checkpoint inhibitor is encoding in the virus.

In one embodiment there is provide a method of treatment comprising administering a virus according to the present disclosure which is NOT in combination with a checkpoint inhibitor (for example as listed elsewhere herein such as a PD-1 or PDL1 inhibitor), in particular wherein the checkpoint inhibitor is not encoding in the virus.

The Bispecific T cell activators encoded by the virus as per the present disclosure have the ability to potentiate the cytotoxicity of the virus.

Surprisingly the Bispecific T cell activators encoded by a virus as per the present disclosure can activate CD4+ cells and/or CD8+ cells, for example even cells in the suppressive environment of the tumor, including T cells in the fluid environment, such as ascites, of the tumor.

Advantageously the Bispecific T cell activators encoded by a virus as per the present disclosure can activate cytotoxic T cells, for example even T cells in the suppressive environment of the tumor, including T cells in the fluid environment, such as ascites, of the tumor.

Even more surprisingly the Bispecific T cell activators encoded by a virus as per the present disclosure are capable of stimulating (activating) T cell proliferation.

The viruses encoding Bispecific T cell activators according to the present disclosure seem to be able to by-pass, overcome or reverse the immune suppressive microenvironment of the tumor.

In one embodiment the activation of T cells results in upregulation of a T cell marker, for example CD25.

DETAILED DESCRIPTION

Immune cell as employed herein is a cell with a functional role in the immune system, including (but not limited to), macrophages, neutrophils, dendritic cells, NK cells, lymphocytes, such as T lymphocytes (in particular T cells and NKT cells).

Antigen binding site as employed herein refers to a portion of the molecule, which comprises a pair of variable regions, in particular a cognate pair that interact specifically with the target antigen.

Specifically, as employed herein, is intended to refer to a binding site that only recognises the antigen to which it is specific or a binding site that has significantly higher binding affinity to the antigen to which it is specific compared to affinity to antigens to which it is non-specific, for example 5, 6, 7, 8, 9, 10 times higher binding affinity. Affinity can be measured by techniques such as BIAcore.

Bi-specific antibody molecule as employed herein refers to a molecule with two antigen binding domains, which may bind the same or different antigens. A Bispecific T cell activator is a subclass of bispecific antibody molecules.

Bispecific T cell activator as employed herein refers to a bispecific T cell activator, in particular comprising an anti- CD3 binding domain and a further binding domain, in this instance an anti-FAP binding domain. Generally, the binding domains are in the form of a scFv. A diagrammatic representation of a Bispecific T cell activator is shown in s FIG. 12.

Thus, Bispecific T cell activator as used herein refers to a class of artificial bispecific monoclonal antibodies comprising 2 scFvs of different antibodies or amino acid sequences from 4 different genes on a single peptide chain of about 55 KDa. One of the scFvs is specific for an immune cell, such as a T cell antigen, such as the CD3 receptor, expressed on the surface of T cells. The other scFv, in the prior art, typically binds to a tumour cell via a tumour-specific molecule. Accordingly, Bispecific T cell activators are able to form a link between T cells and tumour cells by virtue of their specificities for an antigen on the T cell and an antigen on the tumour cell. This leads to activation of the T-cells and triggers the T cells to exert their cytotoxic effects on tumour cells, independently of MHC I or co-stimulatory molecules.

In one embodiment the T cell engager is arranged is the format VL1-linker1-VH1-linker2-VH2-linker3-VL2, for example employing linkers independently selected from linker sequences disclosed herein.

In one embodiment the Bispecific T cell activator Linker is in the range 10 to 30 amino acids in length, such as 10, 11, 12, 13, 14, 15, 16, 17, 18, 19, 20, 21, 22, 23, 24, 25, 26, 27, 28, 29 or 30, for example a linker disclosed herein.

Stroma or stromal antigen as employed herein refers to an antigen therapeutic target in the stroma, including expressed in the molecular structure of the stroma matrix, such as connective tissue molecules or molecules associated with this matrix or antigens associated with the cellular components of the stroma, for example expressed on fibroblasts, tumour-associated macrophages, dendritic cells, NK cells and/or T-cells which have infiltrated the stroma. Examples of stroma antigens include but are not limited to FAP, TGFβ, TREM1, IGFBP7, FSP-1, fibroblast associated antigen, NG2, endosialin (CD248), platelet-derived growth factor-α receptor (PDGFR-α), platelet-derived growth factor-β receptor (PDGFR-β) and vimentin. Generally stromal antigens are not expressed on cancer cells i.e. they are only expressed on stromal cells.

Fibroblasts may be targeted by employing the antigen fibroblast activation protein (FAP), in particular an antibody specific to FAP which does not bind CD26, (see US2012/0258119 incorporated herein by reference).

FAP was originally identified as a serine protease on reactive stromal fibroblasts.

Subsequent molecular cloning revealed that FAP is identical to seprase, a 170 kDa membrane associated gelatinase that is expressed by melanoma cell lines. Full length cDNA encoded a type H transmembrane protease of 760 amino acids (aa) highly homologous to dipeptidyl peptidase IV (DPPIV) with a 52% aa identity over the entire sequence and almost 70% identity in the catalytic domain. U.S. Pat. No. 5,587,299, incorporated herein by reference, describes nucleic acid molecules encoding FAP and applications thereof.

In summary, FAP is recognized as a multifunctional protein that executes its biological functions in a cell dependent manner through a combination of its protease activity and its ability to form complexes with other cell-surface molecules. Over-expression of FAP in epithelial and fibroblastic cell lines promotes malignant behaviour, pointing to the clinical situation, where cellular expression levels of FAP are correlated with worse clinical outcome.

Through paracrine signaling molecules, cancer cells activate stromal fibroblasts and induce the expression of FAP, which in turn, affects the proliferation, invasion and migration of the cancer cells. Recent studies have demonstrated that TGF-β is the dominant factor in promoting FAP protein expression (Chen, H et al (2009) Exp and Molec Pathology, doi: 10.1016/j.yexmp. 2009.09.001). FAP is heavily expressed on reactive stromal fibroblasts in 90% of human epithelial carcinomas, including those of the breast, lung, colorectum and ovary (Garin-Chesa, P et al (1990) PNAS USA 87: 7236-7239). Chen et al have recently shown that FAPα influences the invasion, proliferation and migration of HO-8910PM ovarian cancer cells (Chen, H et al (2009) Exp and Molec Pathology, doi: 10.1016/j.yexmp. 2009.09.001).

FAP may be targeted by binding said antigen and sterically blocking its interaction with biologically relevant molecules. Alternatively, or additionally cross-linking the FAP molecule with another FAP molecule or a different molecule, for example to T cells. This cross linking raised the visibility of the cells bearing the FAP to the immune systems, which then may be activated to neutral or destroy the same.

The adenovirus of the present disclosure has the ability to infect tumour cells, and in particular is chosen to preferentially infect tumour, cells. The oncolytic virus infection causes death and lysis of the cancer cell with release of newly generated virus particles. Incorporated transgenes such as Bispecific T cell activators and cytokine are synthesized in th cells and actively secreted by said tumor cells prior to their death. Some molecules will also be released upon cell lysis.

Antibody molecules, such as Bispecific T cell activators, with a short half-life may be particularly suitable for use in the present disclosure because this minimises off-target effects because the body rapidly clears the molecules if they become systemically available.

Thus, the adenovirus according to the present disclosure has at least two or three mechanisms for attacking the tumour, including indirect mechanisms which undermine the tumour stroma.

Transgene as employed herein refers to a gene that has been inserted into the genome sequence, which is a gene that is unnatural to the virus (exogenous) or not normally found in that particular location in the virus. Examples of transgenes are known in the art and discussed herein. Transgene as employed herein also includes a functional fragment of the gene that is a portion of the gene which when inserted is suitable to perform the function or most of the function of the full-length gene.

Transgene and coding sequence are used interchangeably herein in the context of inserts into the viral genome, unless the context indicates otherwise. Coding sequence as employed herein means, for example a DNA sequence encoding a functional RNA, peptide, polypeptide or protein. Typically, the coding sequence is cDNA for the transgene that encodes the functional RNA, peptide, polypeptide or protein of interest. Functional RNA, peptides, polypeptide and proteins of interest are described below.

Clearly the virus genome contains coding sequences of DNA. Endogenous (naturally occurring genes) in the genomic sequence of the virus are not considered a transgene, within the context of the present specification unless then have been modified by recombinant techniques such that they are in a non-natural location or in a non-natural environment.

In one embodiment transgene, as employed herein refers to a segment of DNA containing a gene or cDNA sequence that has been isolated from one organism and is introduced into a different organism i.e. the virus of the present disclosure. In one embodiment, this non-native segment of DNA may retain the ability to produce functional RNA, peptide, polypeptide or protein.

Thus, in one embodiment the transgene inserted encodes a human or humanised protein, polypeptide or peptide.

Operably linked as employed herein refers to transgenes being associated with the necessary regulatory elements to allo the genes to be functional i.e. to allow the genes to expressed using the cellularly machinery once the virus inside the cell.

In one or more embodiments, the cassette is arranged as shown in the one or more of the Figures or the examples.

Transgene cassette as employed herein refers to a DNA sequence encoding one or more transgenes in the form of one or more coding sequences and one or more regulatory elements.

A transgene cassette may encode one or more monocistronic and/or polycistronic mRNA sequences.

In one embodiment, the transgene or transgene cassette encodes a monocistronic or polycistronic mRNA, and for example the cassette is suitable for insertion into the adenovirus genome at a location under the control of an endogenous promoter or exogenous promoter or a combination thereof.

Monocistronic mRNA as employed herein refers to an mRNA molecule encoding a single functional RNA, peptide, polypeptide or protein.

In one embodiment, the transgene cassette encodes monocistronic mRNA.

In one embodiment the transgene cassette in the context of a cassette encoding monocistronic mRNA means a segment of DNA optionally containing an exogenous promoter (which is a regulatory sequence that will determine where and when the transgene is active) or a splice site (which is a regulatory sequence determining when a mRNA molecule will be cleaved by the spliceosome) a coding sequence (i.e. the transgene), usually derived from the cDNA for the protein of interest, optionally containing a polyA signal sequence and a terminator sequence.

In one embodiment, the transgene cassette may encode one or more polycistronic mRNA sequences.

Polycistronic mRNA as employed herein refers to an mRNA molecule encoding two or more functional RNA, peptides or proteins or a combination thereof. In one embodiment the transgene cassette encodes a polycistronic mRNA.

In one embodiment transgene cassette in the context of a cassette encoding polycistronic mRNA includes a segment of DNA optionally containing an exogenous promoter (which is a regulatory sequence that will determine where and when the transgene is active) or a splice site (which is a regulatory sequence determining when a mRNA molecule will be cleaved by the spliceosome) two or more coding sequences (i.e. the transgenes), usually derived from the cDNA for the protein or peptide of interest, for example wherein each coding sequence is separated by either an IRES or a 2A peptide. Following the last coding sequence to be transcribed, the cassette may optionally contain a polyA sequence and a terminator sequence.

In one embodiment, the transgene cassette encodes a monocistronic mRNA followed by a polycistronic mRNA. In another embodiment the transgene cassette a polycistronic mRNA followed by a monocistronic mRNA.

In one embodiment, the adenovirus is a human adenovirus. "Adenovirus", "serotype" or adenoviral serotype" as employed herein refers to any adenovirus that can be assigned to any of the over 50 currently known adenoviral serotypes, which are classified into subgroups A-F, and further extends to any, as yet, unidentified or unclassified adenoviral serotypes. See, for example, Strauss, "Adenovirus infections in humans," in The Adenoviruses, Ginsberg, ea., Plenum Press, New York, N.Y., pp. 451-596 (1984) and Shenk, "Adenoviridae: The Viruses and Their Replication," in Fields Virology, Vol. 2, Fourth Edition, Knipe, 35ea., Lippincott Williams & Wilkins, pp. 2265-2267 (2001), as shown in Table 1.

TABLE 1

| SubGroup | Adenoviral Serotype |
|---|---|
| A | 12, 18, 31 |
| B | 3, 7, 11, 14, 16, 21, 34, 35, 51 |
| C | 1, 2, 5, 6 |
| D | 8-10, 13, 15, 17, 19, 20, 22-30, 32, 33, 36-39, 42-49, 50 |
| E | 4 |
| F | 40, 41 |

In one embodiment the adenoviruses of the present disclosure are subgroup B viruses, namely, Ad11, in particular Ad11p (the Slobitski strain) and derivatives thereof, such as EnAd.

Adenoviruses are allocated to their groups/serotypes based on the capsid, such as the hexon and/or fibre In one embodiment the adenovirus of the present disclosure is not a group A, C, D, E or F virus. The viruses of the present disclosure do not comprise an adenovirus death protein.

In one embodiment, the adenovirus of the present disclosure is chimeric. When an adenovirus is chimeric then the characteristics of the outer capsid will be employed to determine the serotype. Chimeric as employed herein refers to a virus that comprises DNA from at least two different virus serotypes, including different serotypes within the same group.

In one embodiment, the oncolytic virus has a fibre, hexon and penton proteins from the same serotype, for example Ad11, in particular Ad11p, for example found at positions 30812-31789, 18254-21100 and 13682-15367 of the genomic sequence of the latter wherein the nucleotide positions are relative to genbank ID 217307399 (accession number: GC689208).

In one embodiment, the adenovirus is enadenotucirev (also known as EnAd and formerly as EnAd). Enadenotucirev as employed herein refers the chimeric adenovirus of SEQ ID NO: 28. It is a replication competent oncolytic chimeric adenovirus which has enhanced therapeutic properties compared to wild type adenoviruses (see WO2005/118825). EnAd has a chimeric E2B region, which features DNA from Ad11p and Ad3, and deletions in E3/E4. The structural changes in enadenotucirev result in a genome that is approximately 3.5 kb smaller than Ad11p thereby providing additional "space" for the insertion of transgenes. Almost all of the E3 region and part of the E4 region is deleted in EnAd. Therefore, it has significant space in the genome to accommodate additional genetic material whilst remaining viable. Furthermore, because EnAd is a subgroup B adenovirus, pre-existing immunity in humans is less common than, for example, Ad5. Other examples of chimeric oncolytic viruses with Ad1 fibre, penton and hexon include OvAd1 and OvAd2 (see WO2008/080003 incorporated by reference). Thus in one embodiment the adenovirus employed in OvAd1 or OvAd2.

EnAd seems to preferentially infect tumour cells, replicates rapidly in these cells and causes cell lysis. This, in turn, can generate inflammatory immune responses thereby stimulating the body to also fight the cancer. Part of the success of EnAd is hypothesised to be related to the fast replication of the virus in vivo.

Advantageously arming a virus, with DNA encoding certain proteins, such as a Bispecific T cell activator, that can be expressed inside the cancer cell, may enable the body's own defences to be employed to combat tumour cells more effectively, for example by making the cells more visible to the immune system or by delivering a therapeutic gene/protein preferentially to target tumour cells.

It is important that expression of the transgenes does not adversely affect the replication or other advantageous properties of the virus. Thus, the gene or genes must be inserted in a location that does not compromise the replication competence and other advantageous properties of the virus. In addition, the genome of adenoviruses is tightly packed and therefore it can be difficult to find a suitable location to insert transgenes. This also limits the size of transgenes that can be accommodated.

Oncolytic adenovirus as employed herein means an adenovirus that preferentially kills cancer cells as compared with non-cancer cells. In one embodiment, the oncolytic virus is apoptotic. That is, it hastens programmed cell death.

In one embodiment, the oncolytic virus is cytolytic. The cytolytic activity of oncolytic adenoviruses of the disclosure can be determined in representative tumour cell lines and the data converted to a measurement of potency, for example with an adenovirus belonging to subgroup C, such as Ad5, being used as a standard (i.e. given a potency of 1). A suitable method for determining cytolytic activity is an MTS assay (see Example 4, FIG. 2 of WO2005/118825 incorporated herein by reference).

In one embodiment the oncolytic virus is necrolytic. That is, it causes or hastens cell necrosis or immunogenic cell death. In one embodiment necrolytic cell death is advantageous because it triggers, induces the patients (host) immune responses.

Unless the context indicates otherwise, adenovirus as employed herein refers to a replication capable virus (such as a replication competent virus) and also replication deficient viral vectors.

Replication capable as employed herein refers to a replication competent virus or a virus whose replication is dependent on a factor in the cancer cells, for example an upregulated factor, such as p53 or similar.

In one embodiment the virus is replication competent. Replication competent in the context of the present specification refers to a virus that possesses all the necessary machinery to replicate in cells in vitro and in vivo, i.e. without the assistance of a packaging cell line. A viral vector, for example deleted in the E1 region, capable of replicating in a complementary packaging cell line is not a replication competent virus in the present context.

Viral vectors are replication deficient and require a packaging cell to provide a complementary gene to allow replication.

Adenovirus genome as employed herein means the DNA sequence encoding the structural proteins and elements relevant to the function/life cycle of an adenovirus.

All human adenovirus genomes examined to date have the same general organisation i.e., the genes encoding specific functions are located at the same position in the viral genome (referred to herein as structural elements). Each end of the viral genome has a short sequence known as the inverted terminal repeat (or ITR), which is required for viral replication. The viral genome contains five early transcription units (E1A, E1B, E2, E3, and E4), three delayed early units (IX, IVa2 and E2 late) and one late unit (major late) that is processed to generate five families of late mRNAs (L1-L5). Proteins encoded by the early genes are primarily involved in replication and modulation of the host cell response to infection, whereas the late genes encode viral structural proteins. Early genes are prefixed by the letter E and the late genes are prefixed by the letter L.

The genome of adenoviruses is tightly packed, that is, there is little non-coding sequence, and therefore it can be difficult to find a suitable location to insert transgenes.

In one embodiment the oncolytic or partial oncolytic virus according to the disclosure may be as a result of deletion in the E4 and/or E3 region, for example deleted in part of the E4 region or fully deleted in the E3 region, or alternatively deleted in part of the E4 region (such as E4orf4) and fully deleted in the E3 region, for example as exemplified in the sequences disclosed herein.

In one embodiment the oncolytic virus is EnAd or an active derivate thereof which retains the essential beneficial properties of the virus. EnAd is disclosed in WO2005/118825 (incorporated herein by reference) and the full sequence for the virus is provided herein SEQ ID NO: 28. The chimeric E2B region is disclosed herein as SEQ ID NO: 60.

Advantageously, the adenoviruses of the present disclosure exhibit similar virus activity, for example replication and/or infectivity, profiles to EnAd following infection of a variety of different colon cancer cell lines in vitro.

Structural Elements of Adenoviruses

As the structure of adenoviruses is, in general, similar the elements below are discussed in terms of the structural elements and the commonly used nomenclature referring thereto, which are known to the skilled person. When an element is referred to herein then we refer to the DNA sequence encoding the element or a DNA sequence encoding the same structural protein of the element in an adenovirus. The latter is relevant because of the redundancy of the DNA code. The viruses' preference for codon usage may need to be considered for optimised results.

Any structural element from an adenovirus employed in the viruses of the present disclosure may comprise or consist of the natural sequence or may have similarity over the given length of at least 95%, such as 96%, 97%, 98%, 99% or 100%. The original sequence may be modified to omit 10%, 9%, 8%, 7%, 6%, 5%, 4%, 3%, 2% or 1% of the genetic material. The skilled person is aware that when making changes the reading frames of the virus must be not disrupted such that the expression of structural proteins is disrupted.

In one embodiment the given element is a full-length sequence i.e. the full-length gene.

In one embodiment the given element is less than a full-length and retains the same or corresponding function as the full-length sequence.

In one embodiment for a given element which is optional in the constructs of the present disclosure, the DNA sequence may be less than a full-length and have no functionality.

The structural genes encoding structural or functional proteins of the adenovirus are generally linked by non-coding regions of DNA. Thus, there is some flexibility about where to "cut" the genomic sequence of the structural element of interest (especially non-coding regions thereof) for the purpose of inserting a transgene into the viruses of the present disclosure. Thus for the purposes of the present specification, the element will be considered a structural element of reference to the extent that it is fit for purpose and does not encode extraneous material. Thus, if appropriate the gene will be associated with suitable non-coding regions, for example as found in the natural structure of the virus.

Thus, in one embodiment an insert, such as DNA encoding a restriction site and/or transgene, is inserted into a non-coding region of genomic virus DNA, such as an intron or intergenic sequence. Having said this some non-coding regions of adenovirus may have a function, for example in alternative splicing, transcription regulation or translation regulation, and this may need to be taken into consideration.

The sites identified herein, that are associated with the L5 region (for example between L5 and the E4 region), are suitable for accommodating a variety of DNA sequences encoding complex entities such as RNAi, cytokines, single chain or multimeric proteins, such as antibodies, such as a Bispecific T cell activator.

Gene as employed herein refers to coding and optionally any non-coding sequences associated therewith, for example introns and associated exons. In one embodiment a gene comprises or consists of only essential structural components, for example coding region.

Below follows a discussion relating to specific structural elements of adenoviruses.

The Inverted Terminal Repeat (ITR) sequences are common to all known adenoviruses and were so named because of their symmetry, and are the viral chromosome origins of replication. Another property of these sequences is their ability to form a hairpin.

The 5'ITR as employed herein refers to part or all of an ITR from the 5' end of an adenovirus, which retains the function of the ITR when incorporated into an adenovirus in an appropriate location. In one embodiment the 5'ITR comprises or consists of the sequence from about 1 bp to 138 bp of SEQ ID NO: 28 or a sequence 90, 95, 96, 97, 98 or 99% identical thereto along the whole length, in particular the sequence consisting of from about 1 bp to 138 bp of SEQ ID NO: 28.

The 3'ITR as employed herein refers to part or all of an ITR from 3' end of an adenovirus which retains the function of the ITR when incorporated into an adenovirus in an appropriate location. In one embodiment the 3'ITR comprises or consists of the sequence from about 32189 bp to 32326 bp of SEQ ID NO: 28 or a sequence 90, 95, 96, 97, 98 or 99% identical thereto along the whole length, in particular the sequence consisting of from about 32189 bp to 32326 bp of SEQ ID NO: 28.

$B_1$ as employed herein refers to the DNA sequence encoding: part or all of an E1A from an adenovirus, part or all of the E1B region of an adenovirus, and independently part or all of E1A and E1B region of an adenovirus.

When $B_1$ is a bond then E1A and E1B sequences will be omitted from the virus. In one embodiment $B_1$ is a bond and thus the virus is a vector.

In one embodiment $B_1$ further comprises a transgene. It is known in the art that the E1 region can accommodate a transgene which may be inserted in a disruptive way into the E1 region (i.e. in the "middle" of the sequence) or part or all of the E1 region may be deleted to provide more room to accommodate genetic material.

E1A as employed herein refers to the DNA sequence encoding part or all of an adenovirus E1A region. The latter here is referring to the polypeptide/protein E1A. It may be mutated such that the protein encoded by the E1A gene has conservative or non-conservative amino acid changes, such that it has: the same function as wild-type (i.e. the corresponding non-mutated protein); increased function in comparison to wild-type protein; decreased function, such as no function in comparison to wild-type protein; or has a new function in comparison to wild-type protein or a combination of the same as appropriate.

E1B as employed herein refers to the DNA sequence encoding part or all of an adenovirus E1B region (i.e. polypeptide or protein), it may be mutated such that the protein encoded by the E1B gene/region has conservative or non-conservative amino acid changes, such that it has: the same function as wild-type (i.e. the corresponding non-mutated protein); increased function in comparison to wild-type protein; decreased function, such as no function in comparison to wild-type protein; or has a new function in comparison to wild-type protein or a combination of the same as appropriate.

Thus, $B_1$ can be modified or unmodified relative to a wild-type E1 region, such as a wild-type E1A and/or E1B. The skilled person can easily identify whether E1A and/or E1B are present or (part) deleted or mutated.

Wild-type as employed herein refers to a known adenovirus. A known adenovirus is one that has been identified and named, regardless of whether the sequence is available.

In one embodiment $B_1$ has the sequence from 139 bp to 3932 bp of SEQ ID NO: 28.

$B_A$ as employed herein refers to the DNA sequence encoding the E2B-L1-L2-L3-E2A-L4 regions including any non-coding sequences, as appropriate. Generally, this sequence will not comprise a transgene. In one embodiment the sequence is substantially similar or identical to a contiguous sequence from a known adenovirus, for example a serotype shown in Table 1, in particular a group B virus, for example Ad3, Ad7, Ad11, Ad14, Ad16, Ad21, Ad34, Ad35, Ad51 or a combination thereof, such as Ad3, Ad11 or a combination thereof. In one embodiment is E2B-L1-L2-L3-E2A-L4 refers to comprising these elements and other structural elements associated with the region, for example $B_A$ will generally include the sequence encoding the protein IV2a, for example as follows: IV2A IV2a-E2B-L1-L2-L3-E2A-L4.

In one embodiment the E2B region is chimeric. That is, comprises DNA sequences from two or more different adenoviral serotypes, for example from Ad3 and Ad11, such as Ad11p. In one embodiment the E2B region has the sequence from 5068 bp to 10355 bp of SEQ ID NO: 28 or a sequence 95%, 96%, 97%, 98% or 99% identical thereto over the whole length.

In one embodiment the E2B in component $B_A$ comprises the sequences shown in SEQ ID NO: 60 (which corresponds to SEQ ID NO: 3 disclosed in WO2005/118825).

In one embodiment $B_A$ has the sequence from 3933 bp to 27184 bp of SEQ ID NO: 28.

E3 as employed herein refers to the DNA sequence encoding part or all of an adenovirus E3 region (i.e. protein/polypeptide), it may be mutated such that the protein encoded by the E3 gene has conservative or non-conservative amino acid changes, such that it has the same function as wild-type (the corresponding unmutated protein); increased function in comparison to wild-type protein; decreased function, such as no function in comparison to wild-type protein or has a new function in comparison to wild-type protein or a combination of the same, as appropriate.

In one embodiment the E3 region is form an adenovirus serotype given in Table 1 or a combination thereof, in particular a group B serotype, for example Ad3, Ad7, Ad11

(in particular Ad11p), Ad14, Ad16, Ad21, Ad34, Ad35, Ad51 or a combination thereof, such as Ad3, Ad11 (in particular Ad11p) or a combination thereof.

In one embodiment the E3 region is partially deleted, for example is 95%, 90%, 85%, 80%, 75%, 70%, 65%, 60%, 55%, 50%, 45%, 40%, 35%, 30%, 25%, 20%, 15%, 10%, 5% deleted. In one embodiment $B_2$ is a bond, wherein the DNA encoding the E3 region is absent.

In one embodiment the DNA encoding the E3 region can be replaced or interrupted by a transgene. As employed herein "E3 region replaced by a transgene as employed herein includes part or all of the E3 region is replaced with a transgene.

In one embodiment the $B_2$ region comprises the sequence from 27185 bp to 28165 bp of SEQ ID NO: 28.

In one embodiment $B_2$ consists of the sequence from 27185 bp to 28165 bp of SEQ ID NO: 28.

$B_X$ as employed herein refers to the DNA sequence in the vicinity of the 5' end of the L5 gene in $B_B$. In the vicinity of or proximal to the 5' end of the L5 gene as employed herein refers to: adjacent (contiguous) to the 5' end of the L5 gene or a non-coding region inherently associated herewith i.e. abutting or contiguous to the 5' prime end of the L5 gene or a non-coding region inherently associated therewith. Alternatively, in the vicinity of or proximal to may refer to being close the L5 gene, such that there are no coding sequences between the $B_X$ region and the 5' end of L5 gene.

Thus, in one embodiment $B_X$ is joined directly to a base of L5 which represents, for example the start of a coding sequence of the L5 gene.

Thus, in one embodiment $B_X$ is joined directly to a base of L5 which represents, for example the start of a non-coding sequence, or joined directly to a non-coding region naturally associated with L5. A non-coding region naturally associated L5 as employed herein refers to part of all of a non-coding regions which is part of the L5 gene or contiguous therewith but not part of another gene.

In one embodiment $B_X$ comprises the sequence of SEQ ID NO: 29. This sequence is an artificial non-coding sequence wherein a DNA sequence, for example comprising a transgene (or transgene cassette), a restriction site or a combination thereof may be inserted therein. This sequence is advantageous because it acts as a buffer in that allows some flexibility on the exact location of the transgene whilst minimising the disruptive effects on virus stability and viability.

The insert(s) can occur anywhere within SEQ ID NO: 29 from the 5' end, the 3' end or at any point between bp 1 to 201. In one embodiment $B_X$ comprises SEQ ID NO: 29 with a DNA sequence inserted between bp 27 and bp 28 or a place corresponding to between positions 28192 bp and 28193 bp of SEQ ID NO: 28.

In one embodiment the insert is a restriction site insert. In one embodiment the restriction site insert comprises one or two restriction sites. In one embodiment the restriction site is a 19 bp restriction site insert comprising 2 restriction sites. In one embodiment the restriction site insert is a 9 bp restriction site insert comprising 1 restriction site. In one embodiment the restriction site insert comprises one or two restriction sites and at least one transgene, for example one or two transgenes. In one embodiment the restriction site is a 19 bp restriction site insert comprising 2 restriction sites and at least one transgene, for example one or two transgenes. In one embodiment the restriction site insert is a 9 bp restriction site insert comprising 1 restriction site and at least one transgene, for example one, two or three transgenes, such as one or two. In one embodiment two restriction sites sandwich one or more, such as two transgenes (for example in a transgene cassette). In one embodiment when $B_X$ comprises two restrictions sites the said restriction sites are different from each other. In one embodiment said one or more restrictions sites in $B_X$ are non-naturally occurring in the particular adenovirus genome into which they have been inserted. In one embodiment said one or more restrictions sites in $B_X$ are different to other restrictions sites located elsewhere in the adenovirus genome, for example different to naturally occurring restrictions sites and/or restriction sites introduced into other parts of the genome, such as a restriction site introduced into $B_Y$. Thus in one embodiment the restriction site or sites allow the DNA in the section to be cut specifically.

DNA sequence in relation to $B_Y$ as employed herein refers to the DNA sequence in the vicinity of the 3' end of the L5 gene of $B_B$. In the vicinity of or proximal to the 3' end of the L5 gene as employed herein refers to: adjacent (contiguous) to the 3' end of the L5 gene or a non-coding region inherently associated therewith i.e. abutting or contiguous to the 3' prime end of the L5 gene or a non-coding region inherently associated therewith (i.e. all or part of an non-coding sequence endogenous to L5). Alternatively, in the vicinity of or proximal to may refer to being close the L5 gene, such that there are no coding sequences between the $B_Y$ region and the 3' end of the L5 gene.

Thus, in one embodiment $B_Y$ is joined directly to a base of L5 which represents the "end" of a coding sequence.

Thus, in one embodiment $B_Y$ is joined directly to a base of L5 which represents the "end" of a non-coding sequence, or joined directly to a non-coding region naturally associated with L5.

Inherently and naturally are used interchangeably herein.

In one embodiment $B_Y$ comprises the sequence of SEQ ID NO: 30. This sequence is a non-coding sequence wherein a DNA sequence, for example comprising a transgene (or transgene cassette), a restriction site or a combination thereof may be inserted. This sequence is advantageous because it acts a buffer in that allows some flexibility on the exact location of the transgene whilst minimising the disruptive effects on virus stability and viability.

The insert(s) can occur anywhere within SEQ ID NO: 30 from the 5' end, the 3' end or at any point between bp 1 to 35, for example between base pairs 1/2, 2/3, 3/4, 4/5, 5/6, 6/7, 7/8, 8/9, 9/10, 10/11, 11/12, 12/13, 13/14, 14/15, 15/16, 16/17, 17/18, 18/19, 19/20, 20/21, 21/22, 22/23, 23/24, 24/25, 25/26, 26/27, 27/28, 28/29, 29/30, 30/31, 31/32, 32/33, 33/34, or 34/35.

E4 as employed herein refers to the DNA sequence encoding part or all of an adenovirus E4 region (i.e. polypeptide/protein region), which may be mutated such that the protein encoded by the E4 gene has conservative or non-conservative amino acid changes, and has the same function as wild-type (the corresponding non-mutated protein); increased function in comparison to wild-type protein; decreased function, such as no function in comparison to wild-type protein or has a new function in comparison to wild-type protein or a combination of the same as appropriate. In one embodiment the E4 region has E4orf4 deleted.

In one embodiment the E4 region is partially deleted, for example is 95%, 90%, 85%, 80%, 75%, 70%, 65%, 60%, 55%, 50%, 45%, 40%, 35%, 30%, 25%, 20%, 15%, 10% or 5% deleted. In one embodiment the E4 region has the sequence from 32188 bp to 29380 bp of SEQ ID NO: 28.

In one embodiment $B_3$ is a bond, i.e. wherein E4 is absent.

In one embodiment $B_3$ has the sequence consisting of from 32188 bp to 29380 bp of SEQ ID NO: 28.

As employed herein number ranges are inclusive of the end points.

The skilled person will appreciate that the elements in the formulas herein, such as formula (I) are contiguous and may embody non-coding DNA sequences as well as the genes and coding DNA sequences (structural features) mentioned herein. In one or more embodiments, the formulas of the present disclosure are attempting to describe a naturally occurring sequence in the adenovirus genome. In this context, it will be clear to the skilled person that the formula is referring to the major elements characterising the relevant section of genome and is not intended to be an exhaustive description of the genomic stretch of DNA.

E1A, E1B, E3 and E4 as employed herein each independently refer to the wild-type and equivalents thereof, mutated or partially deleted forms of each region as described herein, in particular a wild-type sequence from a known adenovirus.

"Insert" as employed herein refers to a DNA sequence that is incorporated either at the 5' end, the 3' end or within a given DNA sequence reference segment such that it interrupts the reference sequence. The latter is a reference sequence employed as a reference point relative to which the insert is located. In the context of the present disclosure inserts generally occur within either SEQ ID NO: 29 or SEQ ID NO: 30. An insert can be either a restriction site insert, a transgene cassette or both. When the sequence is interrupted the virus will still comprise the original sequence, but generally it will be as two fragments sandwiching the insert.

In one embodiment the transgene or transgene cassette does not comprise a non-biased inserting transposon, such as a TN7 transposon or part thereof. Tn7 transposon as employed herein refers to a non-biased insertion transposon as described in WO2006/060314.

In one embodiment one or more restrictions sites in $B_X$ and $B_Y$ are independently selected from a restriction site specific to an enzyme described herein, for example NotI, FseI, AsiSI, SgfI and SbfI, in particular the restriction sites inserted are all different, such as sites specific for NotI and sites specific for FseI located in $B_X$ and SgfI and SbfI located in $B_Y$.

As discussed above in one embodiment the region $B_X$ and/or $B_Y$ do not comprise a restriction site. Advantageously, the viruses and constructs of the present disclosure can be prepared without restriction sites, for example using synthetic techniques. These techniques allow a great flexibility in the creation of the viruses and constructs. Furthermore, the present inventors have established that the properties of the viruses and constructs are not diminished when they are prepared by synthetic techniques.

Other Regulatory Sequences

"Regulator of gene expression" (or regulator/regulatory element) as employed herein refers to a genetic feature, such as a promoter, enhancer or a splice acceptor sequence that plays a role in gene expression, typically by initiating or enhancing transcription or translation.

"Splice acceptor sequence", "splice acceptor" or "splice site" as employed herein refers to a regulatory sequence determining when an mRNA molecule will be recognised by small nuclear ribonucleoproteins of the spliceosome complex. Once assembled the spliceosome catalyses splicing between the splice acceptor site of the mRNA molecule to an upstream splice donor site producing a mature mRNA molecule that can be translated to produce a single polypeptide or protein.

Different sized splice acceptor sequences may be employed in the present invention and these can be described as short splice acceptor (small), splice acceptor (medium) and branched splice acceptor (large).

SSA as employed herein means a short splice acceptor, typically comprising just the splice site, for example 4 base pairs. SA as employed herein means a splice acceptor, typically comprising the short splice acceptor and the polypyrimidine tract, for example 16 bp. bSA as employed herein means a branched splice acceptor, typically comprising the short splice acceptor, polypyrimidine tract and the branch point, for example 26 base pairs.

In one embodiment, the SA and bSA splice acceptor employed in the constructs of the disclosure are shown in SEQ ID NO: 45 and 46 respectively. In one embodiment, the SSA is employed in a cassette according to the present disclosure and has the nucleotide sequence CAGG.

In one embodiment the SA is employed in the cassette. In one embodiment the bSA is employed in the cassette.

In one embodiment the splice site is immediately proceeded (i.e. followed in a 5' to 3' direction) by a consensus Kozak sequence. In one embodiment the splice site and the Kozak sequence are separated by up to 100 or less base pairs. In one embodiment the Kozak sequence has the nucleotide sequence of SEQ ID NO: 47.

Typically, when under the control of an endogenous or exogenous promoter (such as an endogenous promoter), the coding sequence will be immediately preceded by a Kozak sequence. The start of the coding region is indicated by the initiation codon (AUG), for example is in the context of the sequence (gcc)gccRccAUGg [SEQ ID NO: 48] the start of the "start" of the coding sequences is indicated by the bases in bold. A lower case letter denotes common bases at this position (which can nevertheless vary) and upper case letters indicate highly-conserved bases, i.e. the 'AUGG' sequence is constant or rarely, if ever, changes; 'R' indicates that a purine (adenine or guanine) is usually observed at this position and the sequence in brackets (gcc) is of uncertain significance. Thus, in one embodiment the initiation codon AUG is incorporated into a Kozak sequence.

Internal Ribosome Entry DNA Sequence as employed herein refers to a DNA sequence encoding an Internal Ribosome Entry Sequence (IRES). IRES as employed herein means a nucleotide sequence that allows for initiation of translation a messenger RNA (mRNA) sequence, including initiation starting within an mRNA sequence. This is particularly useful when the cassette encodes polycistronic mRNA. Using an IRES results in a polycistronic mRNA that is translated into multiple individual proteins or peptides. In one embodiment the Internal Ribosome Entry DNA sequence has the nucleotide sequence of SEQ ID NO: 49. In one embodiment a particular IRES is only used once in the genome. This may have benefits with respect to stability of the genome.

"High self-cleavage efficiency 2A peptide" or "2A peptide" as employed herein refers to a peptide which is efficiently cleaved following translation. Suitable 2A peptides include P2A, F2A, E2A and T2A. The present inventors have noted that once a specific DNA sequence encoding a given 2A peptide is used once, the same specific DNA sequence may not be used a second time. However, redundancy in the DNA code may be utilised to generate a DNA sequence that is translated into the same 2A peptide. Using 2A peptides is particularly useful when the cassette encodes polycistronic mRNA. Using 2A peptides results in a single polypeptide chain being translated which is modified post-translation to generate multiple individual proteins or peptides.

In one embodiment the encoded P2A peptide employed has the amino acid sequence of SEQ ID NO: 50. In one embodiment the encoded F2A peptide employed has the amino acid sequence of SEQ ID NO: 51. In one embodiment the encoded E2A peptide employed has the amino acid sequence of SEQ ID NO: 52. In one embodiment the encoded T2A peptide employed has the amino acid sequence of SEQ ID NO: 53.

In one embodiment an mRNA or each mRNA encoded by a transgene(s) comprise a polyadenylation signal sequence, such as typically at the end of an mRNA sequence, for example as shown in SEQ ID NO: 54. Thus one embodiment the transgene or the transgene cassette comprises at least one sequence encoding a polyadenylation signal sequence.

"PolyA", "Polyadenylation signal" or "polyadenylation sequence" as employed herein means a DNA sequence, usually containing an AATAAA site, that once transcribed can be recognised by a multiprotein complex that cleaves and polyadenylates the nascent mRNA molecule.

In one embodiment the polyadenylation sequence has the nucleotide sequence of SEQ ID NO: 54.

In one embodiment the construct does not include a polyadenylation sequence. In one embodiment the regulator of gene expression is a splice acceptor sequence.

Advantageously adenoviruses of the present disclosure express and release antibody forms (such as a Bispecific T cell activator) and other proteins, such as cytokines, encoded by a transgene therein into the culture supernatant in vitro or into tumour tissue stroma in vivo. Leader sequences may assist the encoded proteins/polypeptide or peptide exiting the cancer cell. Therefore, in one embodiment the encoded "protein" comprises a leader sequence. Leader sequence as employed herein refers to a polynucleotide sequence located between the promoter sequence and the coding region which can regulate gene expression at the level of transcription or translation.

In one embodiment, the adenovirus according to the present disclosure comprise a transgene which is a reporter gene encoding, for example an imaging agent including bioluminescent, fluorescent imaging agents (including activatable fluorescent imaging agents), such as luciferase, GFP or eGFP or red fluorescent protein.

Reporter gene or reporter sequence as employed herein means a gene or DNA sequence that produces a product easily detected in eukaryotic cells and may be used as a marker to determine the activity of another gene with which its DNA has been closely linked or combined. Reporter genes confer characteristics on cells or organisms expressing them that are easily identified and measured, or are selectable markers. Reporter genes are often used as an indication of whether a certain gene has been taken up by or expressed in the cell or organism population. Examples of common reporter genes include, but are not limited to, LacZ, luciferase, GFP, eGFP, neomycin phosphotransferase, chloramphenicol acetyltransferase, sodium iodide symporter (NIS), nitroreductase (e.g. NfsA, NfsB) intracellular metalloproteins, HSV1-tk or oestrogen receptor.

In one embodiment the genetic material (in particular the transgene) does not encode or express a reporter gene such as an imaging agent, luciferase, GFP or eGFP.

Viruses according to the present disclosure can be investigated for their preference for a specific tumour type by examination of its lytic potential in a panel of tumour cells, for example colon tumour cell lines include HT-29, DLD-1, LS174T, LS1034, SW403, HCT116, SW48, and Colo320DM. Any available colon tumour cell lines would be equally useful for such an evaluation.

Prostate cell lines include DU145 and PC-3 cells. Pancreatic cell lines include Panc-1 cells. Breast tumour cell lines include MDA231 cell line and ovarian cell lines include the OVCAR-3 cell line. Hemopoietic cell lines include, but are not limited to, the Raji and Daudi B-lymphoid cells, K562 erythroblastoid cells, U937 myeloid cells, and HSB2 T-lymphoid cells. Other available tumour cell lines are equally useful.

The present disclosure also extends to novel sequences disclosed herein. In one embodiment the virus is shown in any one of sequences disclosed herein.

Formulations

The present disclosure relates also extends to a pharmaceutical formulation of a virus as described herein.

In one embodiment there is provided a liquid parenteral formulation, for example for infusion or injection, of a replication capable oncolytic according to the present disclosure wherein the formulation provides a dose in the range of $1 \times 10^{10}$ to $1 \times 10^{14}$ viral particles per volume of dose.

Parenteral formulation means a formulation designed not to be delivered through the GI tract Typical parenteral delivery routes include injection, implantation or infusion. In one embodiment the formulation is provided in a form for bolus delivery.

In one embodiment the parenteral formulation is in the form of an injection. Injection includes intravenous, subcutaneous, intra-tumoural or intramuscular injection. Injection as employed herein means the insertion of liquid into the body via a syringe. In one embodiment, the method of the present disclosure does not involve intra-tumoural injection.

In one embodiment the parenteral formulation is in the form of an infusion.

Infusion as employed herein means the administration of fluids at a slower rate by drip, infusion pump, syringe driver or equivalent device. In one embodiment, the infusion is administered over a period in the range of 1.5 minutes to 120 minutes, such as about 3, 4, 5, 6, 7, 8, 9, 10, 11, 12, 13, 14 15, 16, 17, 18, 19 20, 25, 30, 35, 40, 45, 50, 55, 60, 65, 70, 65, 80, 85, 90, 95, 100, 105, 110 or 115 minutes.

In one embodiment one dose of the formulation less than 100 mls, for example 30 mls, such as administered by a syringe driver. In one embodiment one dose of the formulation is less than 10 mls, for example 9, 8, 7, 6, 5, 4, 3, 2 or 1 mls. In one embodiment one dose of the formulation is less than 1 ml, such as 0.9, 0.8, 0.7, 0.6, 0.5, 0.4, 0.3, 0.2 or 0.1 mls.

In one embodiment, the injection is administered as a slow injection, for example over a period of 1.5 to 30 minutes.

In one embodiment, the formulation is for intravenous (i.v.) administration. This route is particularly effective for delivery of oncolytic virus because it allows rapid access to the majority of the organs and tissue and is particular useful for the treatment of metastases, for example established metastases especially those located in highly vascularised regions such as the liver and lungs.

Therapeutic formulations typically will be sterile and stable under the conditions of manufacture and storage. The composition can be formulated as a solution, microemulsion, liposome, or other parenteral formulation suitable for administration to a human and may be formulated as a pre-filled device such as a syringe or vial, particular as a single dose.

The formulation will generally comprise a pharmaceutically acceptable diluent or carrier, for example a non-toxic, isotonic carrier that is compatible with the virus, and in which the virus is stable for the requisite period of time.

The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a dispersant or surfactant such as lecithin or a non-ionic surfactant such as polysorbate 80 or 40. In dispersions the maintenance of the required particle size may be assisted by the presence of a surfactant Examples of isotonic agents include sugars, polyalcohols such as mannitol, sorbitol, or sodium chloride in the composition.

In one embodiment, parenteral formulations employed may comprise one or more of the following a buffer, for example 4-(2-hydroxyethyl)-1-piperazineethanesulfonic acid, a phosphate buffer and/or a Tris buffer, a sugar for example dextrose, mannose, sucrose or similar, a salt such as sodium chloride, magnesium chloride or potassium chloride, a detergent such as a non-ionic surfactant such as briji, PS-80, PS-40 or similar. The formulation may also comprise a preservative such as EDTA or ethanol or a combination of EDTA and ethanol, which are thought to prevent one or more pathways of possible degradation.

In one embodiment, the formulation will comprise purified oncolytic virus according to the present disclosure, for example $1 \times 10^{10}$ to $1 \times 10^{14}$ viral particles per dose, such as $1 \times 10^{10}$ to $1 \times 10^{12}$ viral particles per dose. In one embodiment the concentration of virus in the formulation is in the range $2 \times 10^8$ to $2 \times 10^{14}$ vp/mL, such as $2 \times 10^{12}$ vp/ml.

In one embodiment, the parenteral formulation comprises glycerol.

In one embodiment, the formulation comprises oncolytic adenovirus as described herein, HEPES (N-2-hydroxyethylpiperazine-N'-2-ethanesulfonic acid), glycerol and buffer.

In one embodiment, the parenteral formulation consists of virus of the disclosure, HEPES for example 5 mM, glycerol for example 5-20% (v/v), hydrochloric acid, for example to adjust the pH into the range 7-8 and water for injection.

In one embodiment 0.7 mL of virus of the disclosure at a concentration of $2 \times 10^{12}$ vp/mL is formulated in 5 mM HEPES, 20% glycerol with a final pH of 7.8.

A thorough discussion of pharmaceutically acceptable carriers is available in Remington's Pharmaceutical Sciences (Mack Publishing Company, N.J. 1991).

In one embodiment, the formulation is provided as a formulation for topical administrations including inhalation.

Suitable inhalable preparations include inhalable powders, metering aerosols containing propellant gases or inhalable solutions free from propellant gases. Inhalable powders according to the disclosure will generally contain a virus as described herein with a physiologically acceptable excipient.

These inhalable powders may include monosaccharides (e.g. glucose or arabinose), disaccharides (e.g. lactose, saccharose, maltose), oligo- and polysaccharides (e.g. dextranes), polyalcohols (e.g. sorbitol, mannitol, xylitol), salts (e.g. sodium chloride, calcium carbonate) or mixtures of these with one another. Mono- or disaccharides are suitably used, the use of lactose or glucose, particularly but not exclusively in the form of their hydrates.

Particles for deposition in the lung require a particle size less than 10 microns, such as 1-9 microns for example from 0.1 to 5 μm, in particular from 1 to 5 μm. The particle size of the carrying the virus is of primary importance and thus in one embodiment the virus according to the present disclosure may be adsorbed or absorbed onto a particle, such as a lactose particle of the given size.

The propellant gases which can be used to prepare the inhalable aerosols are known in the art. Suitable propellant gases are selected from among hydrocarbons such as n-propane, n-butane or isobutane and halohydrocarbons such as chlorinated and/or fluorinated derivatives of methane, ethane, propane, butane, cyclopropane or cyclobutane. The above-mentioned propellant gases may be used on their own or in mixtures thereof.

Particularly suitable propellant gases are halogenated alkane derivatives selected from among TG 11, TG 12, TG 134a and TG227. Of the abovementioned halogenated hydrocarbons, TG134a (1,1,1,2-tetrafluoroethane) and TG227 (1,1,1,2,3,3,3-heptafluoropropane) and mixtures thereof are particularly suitable.

The propellant gas-containing inhalable aerosols may also contain other ingredients, such as cosolvents, stabilisers, surface-active agents (surfactants), antioxidants, lubricants and means for adjusting the pH. All these ingredients are known in the art. The propellant gas-containing inhalable aerosols according to the invention may contain up to 5% by weight of active substance. Aerosols according to the invention contain, for example, 0.002 to 5% by weight, 0.01 to 3% by weight, 0.015 to 2% by weight, 0.1 to 2% by weight, 0.5 to 2% by weight or 0.5 to 1% by weight of active ingredient.

Alternatively, topical administrations to the lung may also be by administration of a liquid solution or suspension formulation, for example employing a device such as a nebulizer, for example, a nebulizer connected to a compressor (e.g., the Pari LC-Jet Plus® nebulizer connected to a Pari Master® compressor manufactured by Pari Respiratory Equipment, Inc., Richmond, Va.).

The virus of the invention can be delivered dispersed in a solvent, e.g. in the form of a solution or a suspension, for example as already described above for parenteral formulations. It can be suspended in an appropriate physiological solution, e.g., saline or other pharmacologically acceptable solvent or a buffered solution. Buffered solutions known in the art may contain 0.05 mg to 0.15 mg disodium edetate, 8.0 mg to 9.0 mg NaCl, 0.15 mg to 0.25 mg polysorbate, 0.25 mg to 0.30 mg anhydrous citric acid, and 0.45 mg to 0.55 mg sodium citrate per 1 ml of water so as to achieve a pH of about 4.0 to 5.0.

The therapeutic suspensions or solution formulations can also contain one or more excipients. Excipients are well known in the art and include buffers (e.g., citrate buffer, phosphate buffer, acetate buffer and bicarbonate buffer), amino acids, urea, alcohols, ascorbic acid, phospholipids, proteins (e.g., serum albumin), EDTA, sodium chloride, liposomes, mannitol, sorbitol, and glycerol. Solutions or suspensions can be encapsulated in liposomes or biodegradable microspheres. The formulation will generally be provided in a substantially sterile form employing sterile manufacture processes.

This may include production and sterilization by filtration of the buffered solvent/solution used for the formulation, aseptic suspension of the antibody in the sterile buffered solvent solution and dispensing of the formulation into sterile receptacles by methods familiar to those of ordinary skill in the art.

Nebulisable formulation according to the present disclosure may be provided, for example, as single dose units (e.g., sealed plastic containers or vials) packed in foil envelopes. Each vial contains a unit dose in a volume, e.g., 2 mL, of solvent/solution buffer.

Treatment

In a further aspect, the present disclosure extends to a virus or a formulation thereof as described herein for use in treatment, in particular for the treatment of cancer.

In one embodiment, the method of treatment is for use in the treatment of a tumour, in particular a solid tumour.

Tumour as employed herein is intended to refer to an abnormal mass of tissue that results from excessive cell division that is uncontrolled and progressive, also called a neoplasm. Tumours may be either benign (not cancerous) or malignant Tumour encompasses all forms of cancer and metastases.

In one embodiment, the tumour is a solid tumour. The solid tumour may be localised or metastasised.

In one embodiment, the tumour is of epithelial origin.

In one embodiment, the tumour is a malignancy, such as colorectal cancer, hepatoma, prostate cancer, pancreatic cancer, breast cancer, ovarian cancer, thyroid cancer, renal cancer, bladder cancer, head and neck cancer or lung cancer.

In one embodiment, the tumour is a colorectal malignancy.

Malignancy as employed herein means cancerous cells.

In one embodiment, the oncolytic adenovirus is employed in the treatment or prevention of metastasis.

In one embodiment, the method or formulation herein is employed in the treatment of drug resistant cancers.

In one embodiment, the virus is administered in combination with the administration of a further cancer treatment or therapy.

In one embodiment, there is provided a virus or formulation according to the present disclosure for use in the manufacture of a medicament for the treatment of cancer, for example a cancer described above.

In a further aspect, there is provide a method of treating cancer comprising administering a therapeutically effective amount of a virus or formulation according to the present disclosure to a patient in need thereof, for example a human patient.

In one embodiment, the oncolytic virus or formulation herein is administered in combination with another therapy.

"In combination" as employed herein is intended to encompass where the oncolytic virus is administered before, concurrently and/or post cancer treatment or therapy.

Cancer therapy includes surgery, radiation therapy, targeted therapy and/or chemotherapy. Cancer treatment as employed herein refers to treatment with a therapeutic compound or biological agent, for example an antibody intended to treat the cancer and/or maintenance therapy thereof.

In one embodiment, the cancer treatment is selected from any other anti-cancer therapy including a chemotherapeutic agent, a targeted anticancer agent, radiotherapy, radio-isotope therapy or any combination thereof.

In one embodiment, the virus of the present disclosure such as an oncolytic adenovirus may be used as a pre-treatment to the therapy, such as a surgery (neoadjuvant therapy), to shrink the tumour, to treat metastasis and/or prevent metastasis or further metastasis. The oncolytic adenovirus may be used after the therapy, such as a surgery (adjuvant therapy), to treat metastasis and/or prevent metastasis or further metastasis.

Concurrently as employed herein is the administration of the additional cancer treatment at the same time or approximately the same time as the oncolytic adenovirus formulation. The treatment may be contained within the same formulation or administered as a separate formulation.

In one embodiment, the virus is administered in combination with the administration of a chemotherapeutic agent.

Chemotherapeutic agent as employed herein is intended to refer to specific antineoplastic chemical agents or drugs that are selectively destructive to malignant cells and tissues. For example, alkylating agents, antimetabolites, anthracyclines, plant alkaloids, topoisomerase inhibitors, and other antitumour agents. Other examples of chemotherapy include doxorubicin, 5-fluorouracil (5-FU), paclitaxel, capecitabine, irinotecan, and platins such as cisplatin and oxaliplatin. The preferred dose may be chosen by the practitioner based on the nature of the cancer being treated.

In one embodiment the therapeutic agent is ganciclovir, which may assist in controlling immune responses and/or tumour vascularisation.

In one embodiment one or more therapies employed in the method herein are metronomic, that is a continuous or frequent treatment with low doses of anticancer drugs, often given concomitant with other methods of therapy.

Subgroup B oncolytic adenoviruses, in particular Ad11 and those derived therefrom such as EnAd may be particularly synergistic with chemotherapeutics because they seem to have a mechanism of action that is largely independent of apoptosis, killing cancer cells by a predominantly necrolytic mechanism. Moreover, the immunosuppression that occurs during chemotherapy may allow the oncolytic virus to function with greater efficiency.

Therapeutic dose as employed herein refers to the amount of virus, such as oncolytic adenovirus that is suitable for achieving the intended therapeutic effect when employed in a suitable treatment regimen, for example ameliorates symptoms or conditions of a disease. A dose may be considered a therapeutic dose in the treatment of cancer or metastases when the number of viral particles may be sufficient to result in the following: tumour or metastatic growth is slowed or stopped, or the tumour or metastasis is found to shrink in size, and/or the life span of the patient is extended. Suitable therapeutic doses are generally a balance between therapeutic effect and tolerable toxicity, for example where the side-effect and toxicity are tolerable given the benefit achieved by the therapy.

In one embodiment, a virus or therapeutic construct according to the present disclosure (including a formulation comprising same) is administered weekly, for example one week 1 the dose is administered on day 1, 3, 5, followed by one dose each subsequent week.

In one embodiment, a virus or therapeutic construct according to the present disclosure (including a formulation comprising same) is administered bi-weekly or tri-weekly, for example is administered in week 1 one on days 1, 3 and 5, and on week 2 or 3 is also administered on days 1, 3 and 5 thereof. This dosing regimen may be repeated as many times as appropriate.

In one embodiment, a virus or therapeutic construct according to the present disclosure (including a formulation comprising same) is administered monthly.

In one embodiment, the viruses and constructs of the present disclosure are prepared by recombinant techniques. The skilled person will appreciate that the armed adenovirus genome can be manufactured by other technical means, including entirely synthesising the genome or a plasmid comprising part of all of the genome. The skilled person will appreciate that in the event of synthesising the genome the region of insertion may not comprise the restriction site nucleotides as the latter are artefacts following insertion of genes using cloning methods.

The disclosure herein further extends to an adenovirus of formula (I) or a subformula thereof, obtained or obtainable from inserting a transgene or transgene cassette.

"Is" as employed herein means comprising.

In the context of this specification "comprising" is to be interpreted as "including".

Embodiments of the invention comprising certain features/elements are also intended to extend to alternative embodiments "consisting" or "consisting essentially" of the relevant elements/features.

Where technically appropriate, embodiments of the invention may be combined.

Technical references such as patents and applications are incorporated herein by reference.

Any embodiments specifically and explicitly recited herein may form the basis of a disclaimer either alone or in combination with one or more further embodiments.

The present application claims priority from GB1713765.4, WO2018/041838 and WO2018/041827 incorporated herein by reference. These documents may be employed to correct errors in the present specification, in particular an error in the sequence listing.

The present invention is further described by way of illustration only in the following examples, which refer to the accompanying Figures, in which:

DESCRIPTION OF THE FIGURES

FIGS. 2A-2C: Virus genome replication in lung, breast and bladder carcinoma cell lines.

A549 (2A), MDA-MB-453 (2B) and RT4 (2C) cell lines were treated with NG-617, NG-615, NG-640, NG-641 or enadenotucirev virus particles for up to 7 days. The amount of virus genome detected by qPCR was assessed at days 2, 3, 4 and 7 post treatment.

Figure 3A:
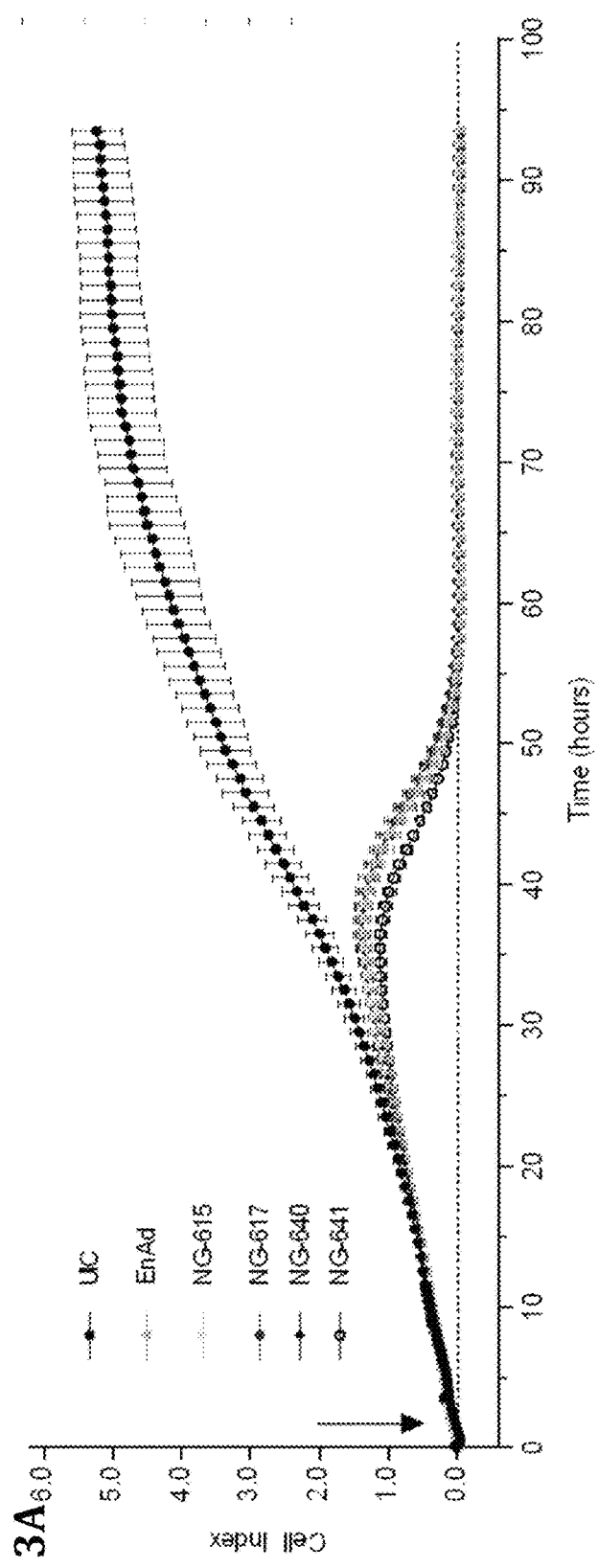
Figure 3B:
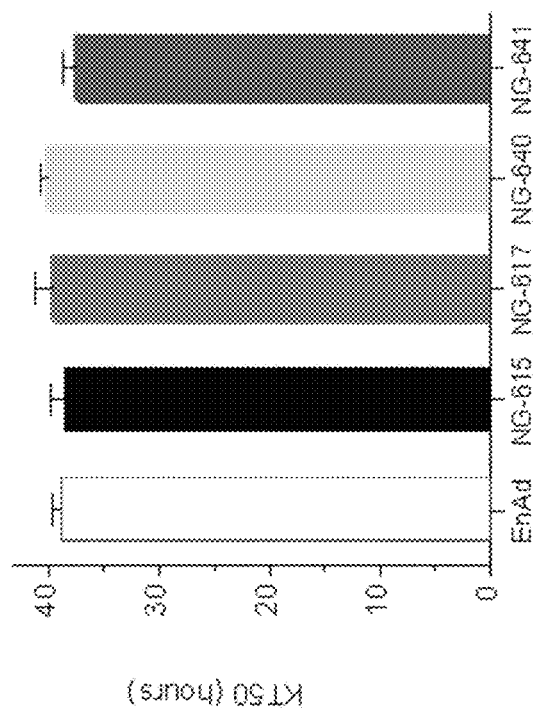

FIGS. 3A-3B: Virus mediated oncolysis of lung carcinoma cells. A549 cells were treated with NG-617, NG-615, NG-640, NG-641 or enadenotucirev virus particles for up to 4 days. Cell viability was assessed throughout the culture using an xCelligence system (3A). The time at which 50% killing was observed (KT50) was determined for each virus treatment (3B).

FIG. 4: NG-615 transgene expression in lung and bladder carcinoma cells. A549 (left panels) and RT4 cells (right panels) were treated with NG-615 or enadenotucirev virus particles or left uninfected for up to 7 days. The secretion of the Flt3 Ligand (A), MIP1α (B) and IFNα (C) was assessed in the cellular supernatants by ELISA. No transgene expression was detected in enadenotucirev treated or untreated control cells (data not shown).

FIG. 5: NG-641 transgene expression in lung and bladder carcinoma cells. A549 (left panels) and RT4 cells (right panels) were treated with NG-641 or enadenotucirev virus particles or left uninfected for up to 7 days. The secretion of the CXCL9 (A), CXCL10 (B) or IFNα (C) was assessed in the cellular supernatants by ELISA. No transgene expression was detected in enadenotucirev treated or untreated control cells (data not shown)

Figure 6A:
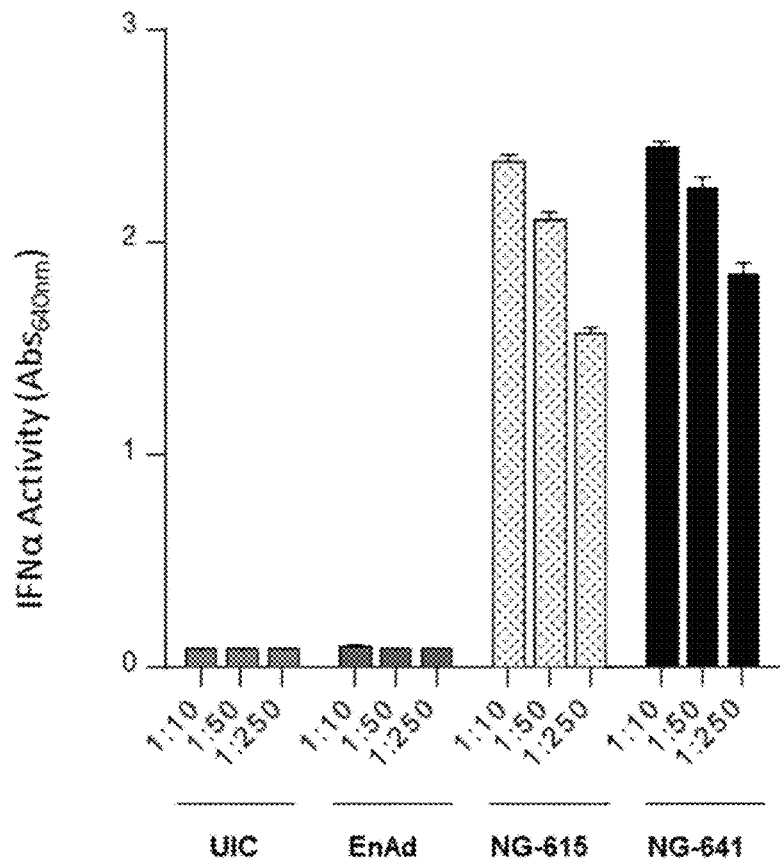
Figure 6B:
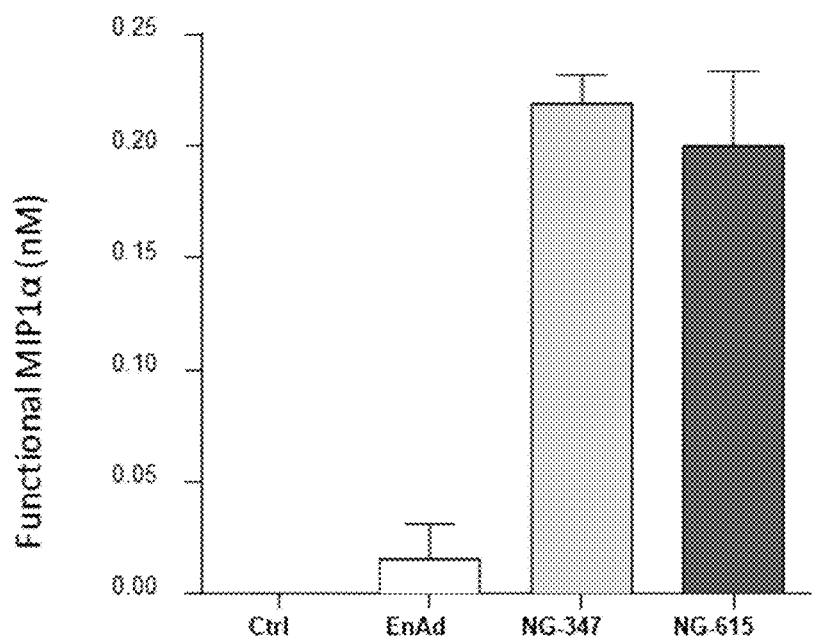

FIGS. 6A-6B: Expression of functional transgenes in lung carcinoma cells. A549 cells were treated with NG-615, NG-641 or enadenotucirev virus particles for up to 4 days. At day 4 post-treatment the level of functional IFNα (6A) or MIP1α (6B) transgenes being produced was assessed using cell-based reporter assays.

Figure 7:
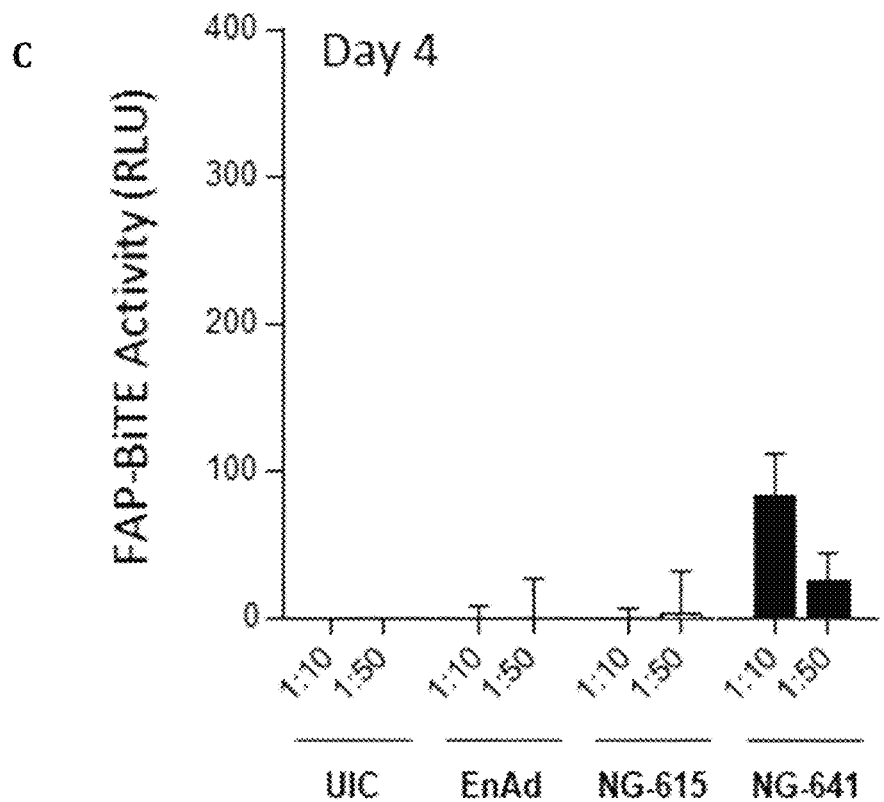

FIG. 7: Expression of functional FAP-Bispecific T cell activator in lung carcinoma cells. A549 cells were treated with NG-615, NG-641 or enadenotucirev virus particles for up to 4 days. At days 2 (A), 3 (B) and 4 (C) post-treatment the expression level of functional FAP-Bispecific T cell activator in the cell supernatants was assessed by measuring activation of a Jurkat T cell line co-cultured with FAP expressing fibroblast cell line, MRC-5.

Figure 8A:
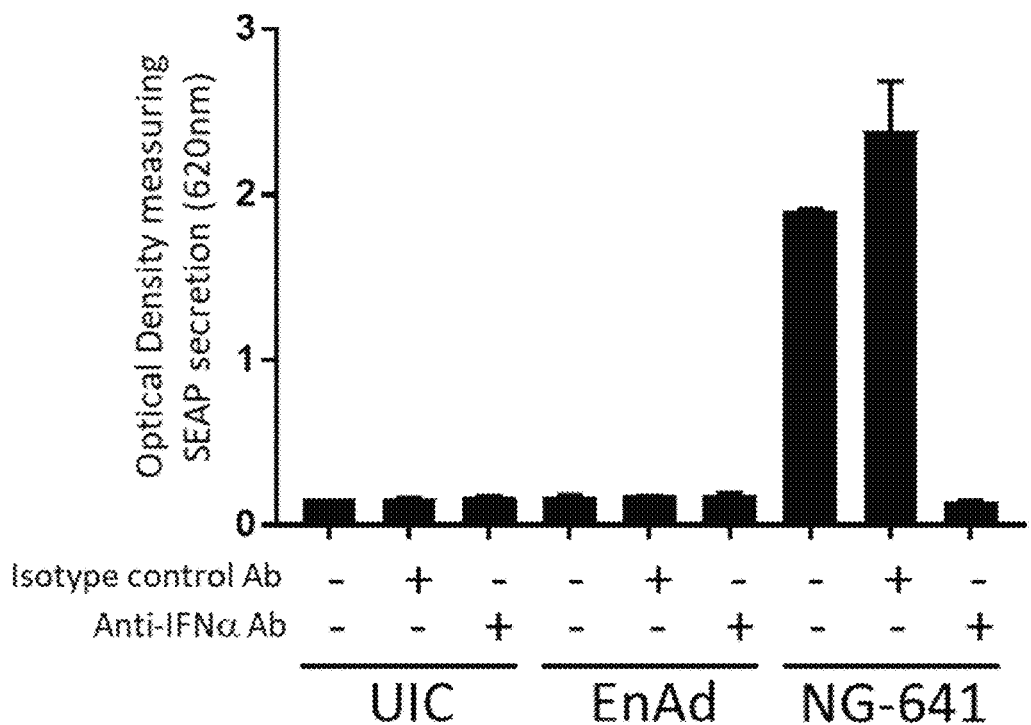

FIG. 8A: Transgene encoded IFNα in supernatant from NG-641 infected A549 cells induces SEAP production by Jurkat Dual reporter cells. Jurkat-Dual reporter cells were treated with supernatant from an A549 cancer cell line either uninfected (UIC) or infected with enadenotucirev (EnAd) or NG-641 and the level of the secreted embryonic alkaline phosphatase (SEAP) reporter measured.

Figure 8B:
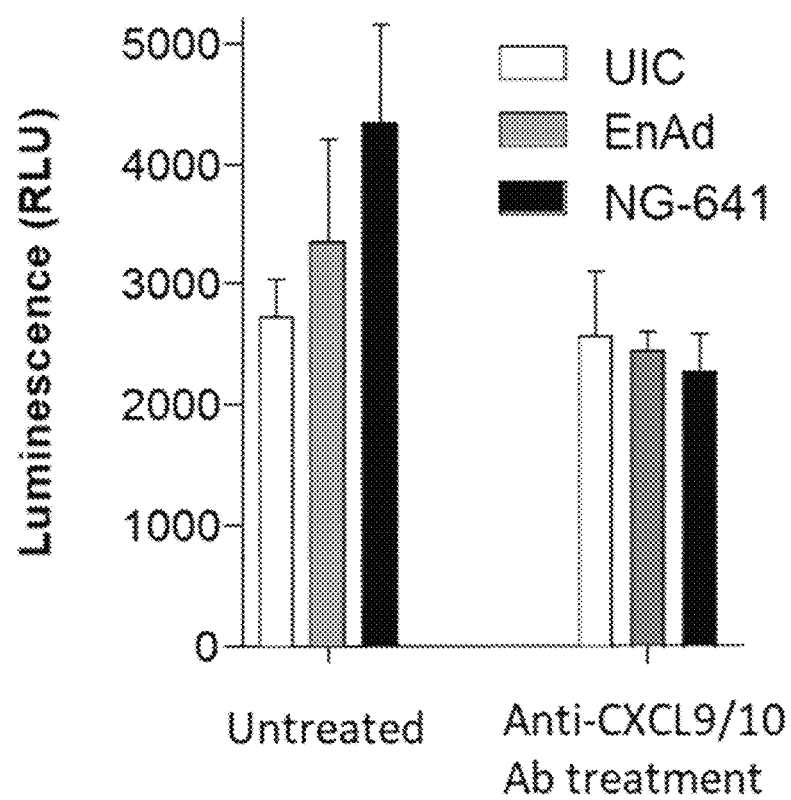

FIG. 8B: Transgene encoded CXCL9/10 in supernatant from NG-641 infected A549 cells activates the GPCR pathway in PathHunter β-Arrestin cells. PathHunter β-Arrestin cells were treated with supernatant from an A549 cancer cell line either uninfected (UIC) or infected with enadenotucirev (EnAd) or NG-641 and CXCL9/10 specific induction of the G-protein coupled receptor (GPCR) pathway detected via luminescence.

Figure 9:
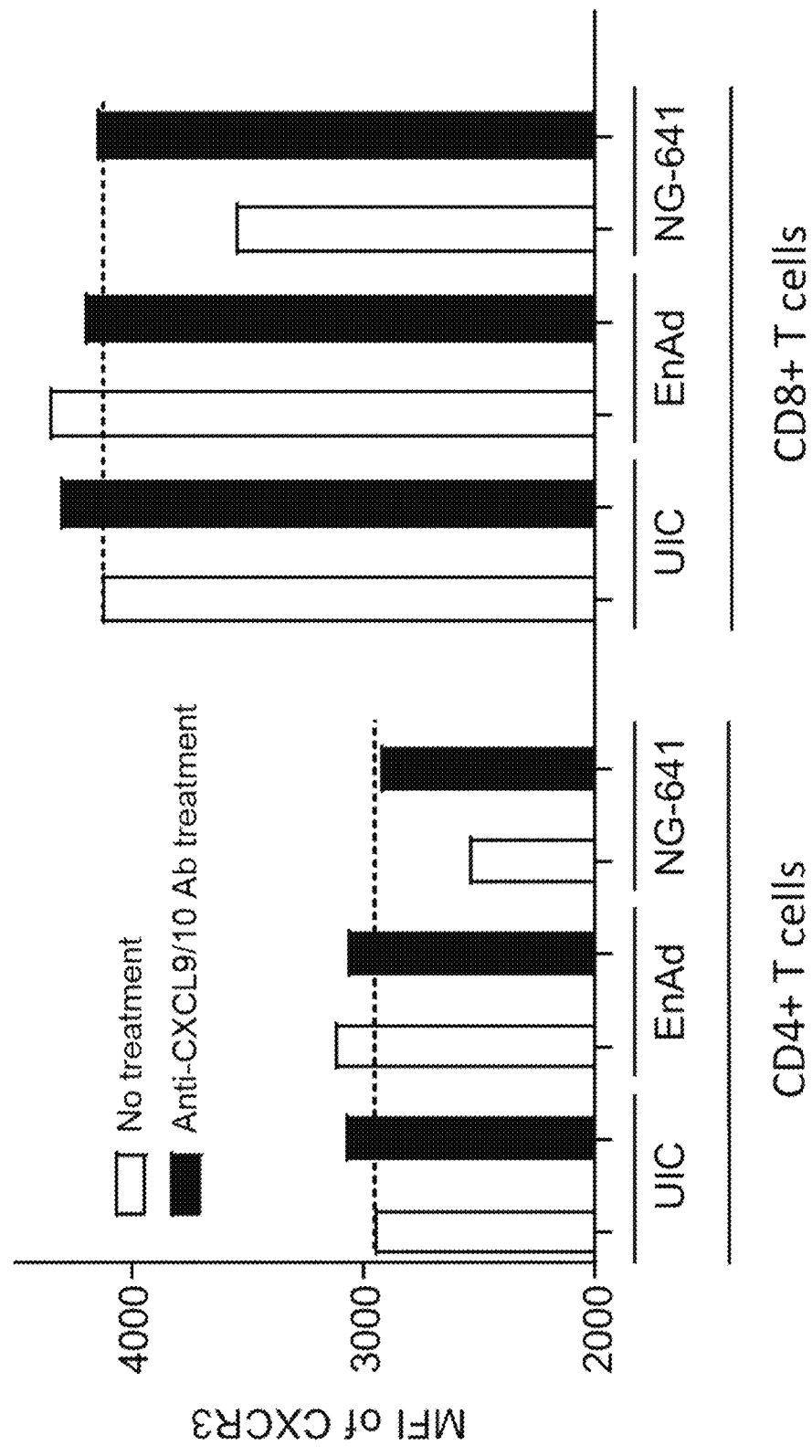

FIG. 9: Transgene encoded CXCL9/10 in supernatant from NG-641 infected A549 cells induces the downregulation of CXCR3 on the surface of activated T cells. Anti-CD3/CD28 activated human T cells were treated with supernatant from an A549 cancer cell line either uninfected (UIC) or infected with enadenotucirev (EnAd) or NG-641 and transgene CXCL9/10 induced downregulation of CXCR3 was measured by flow cytometry.

Figure 10A:
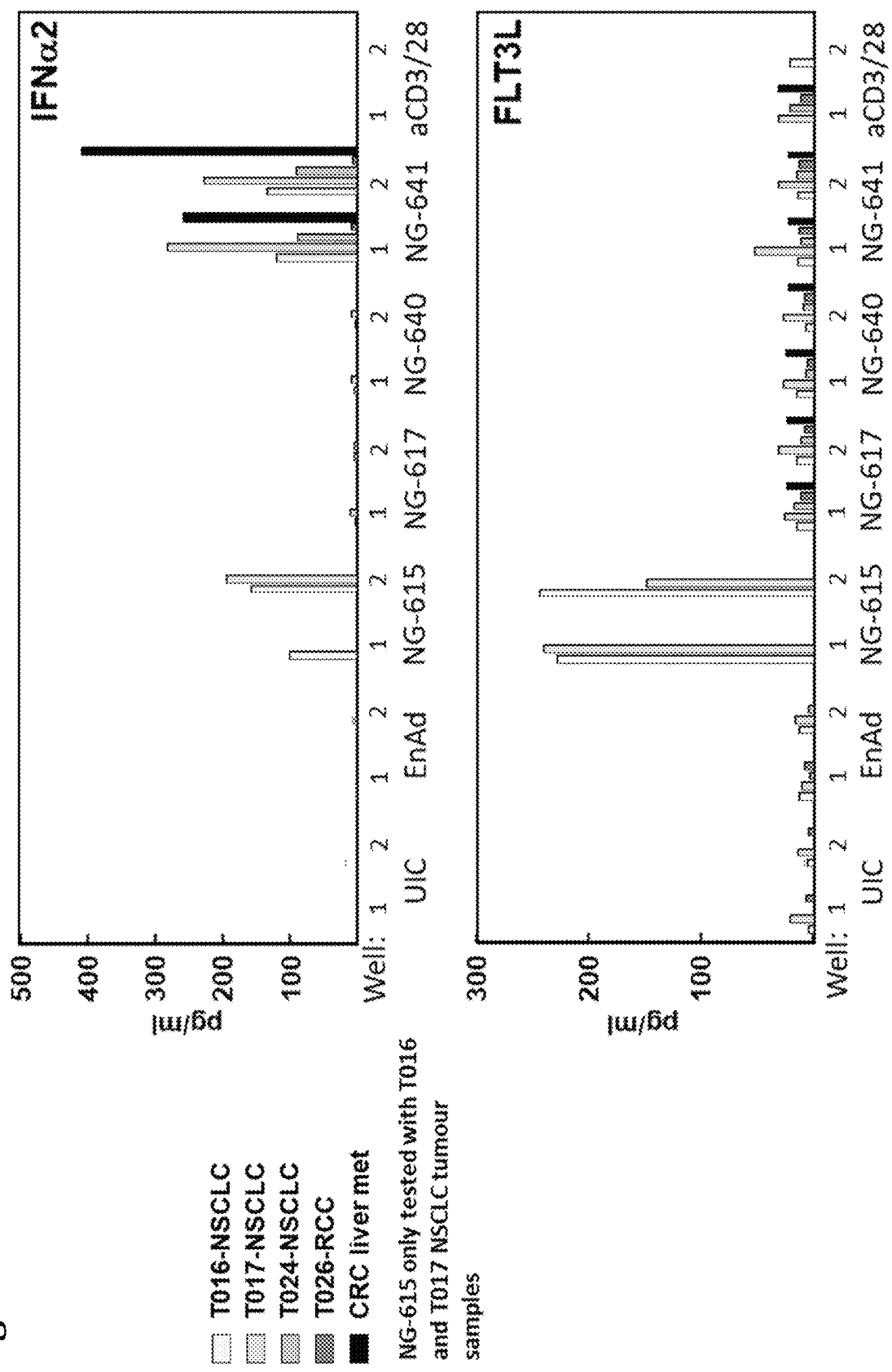
Figure 10B:
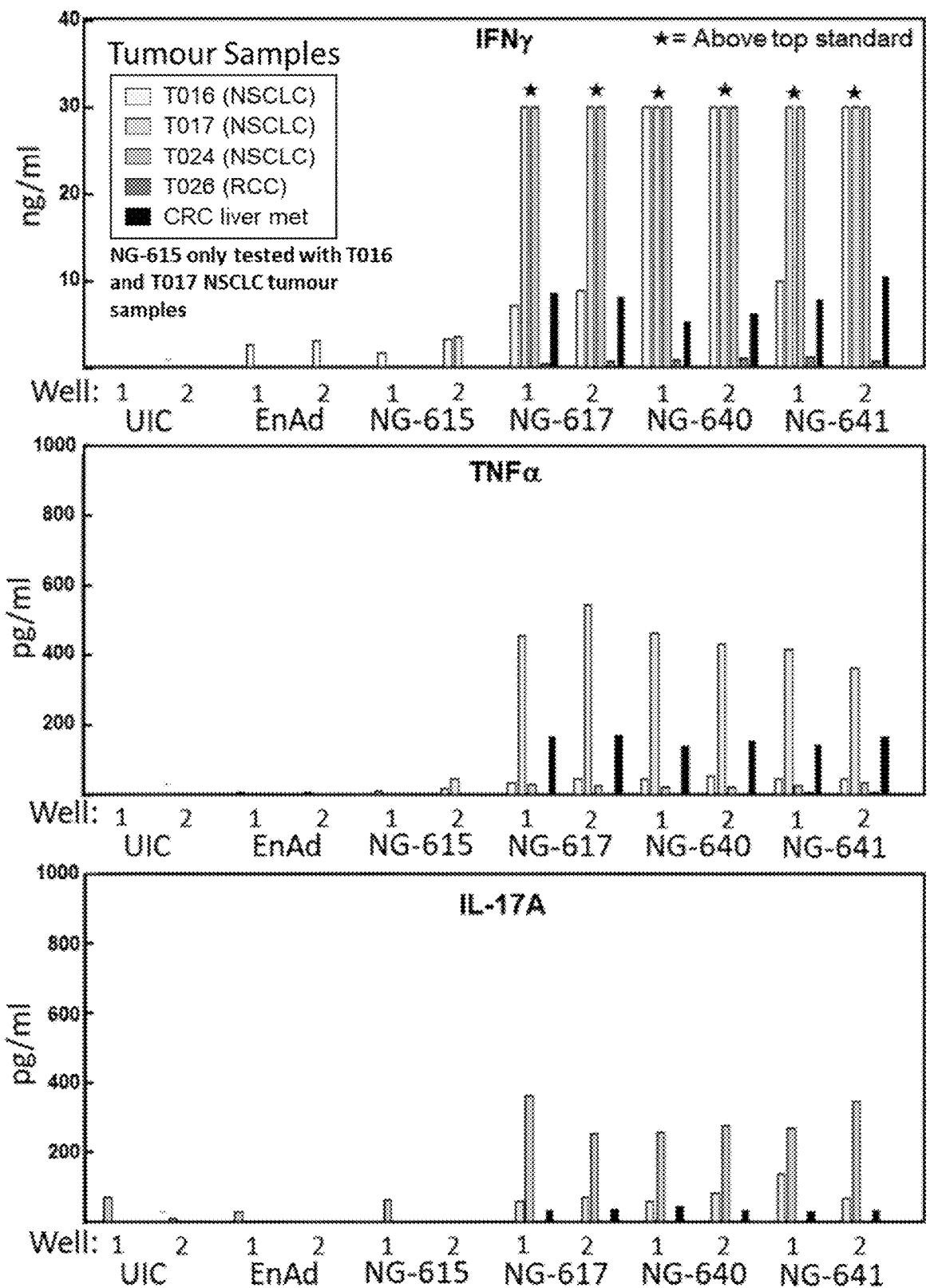
Figure 10B:
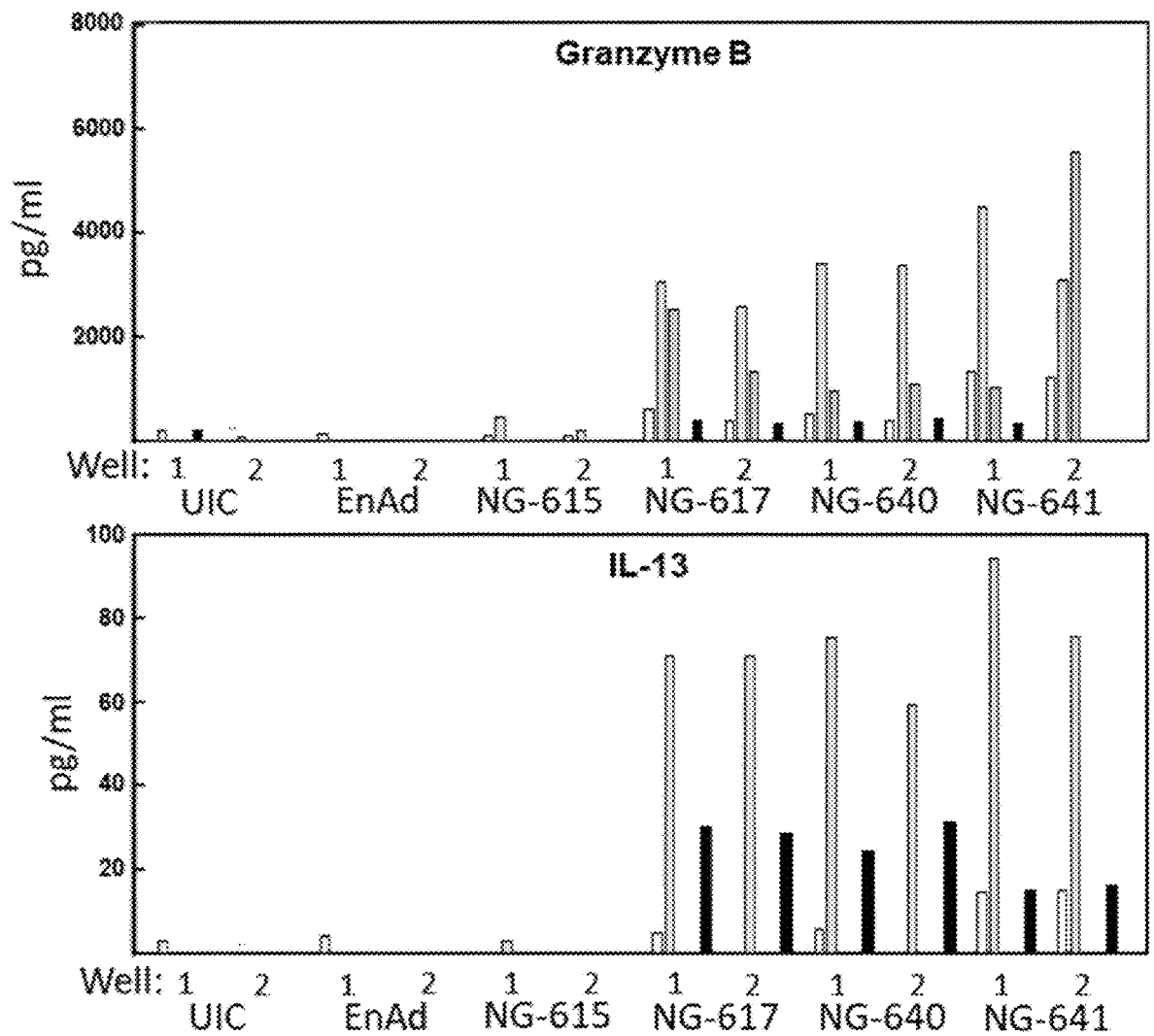

FIGS. 10A-10B: Activation of endogenous tumour infiltrating T-cells in ex vivo cultures of primary human tumour samples inoculated with EnAd, NG-615, NG-617, NG-640 or NG-641, anti-CD3/28 or left uninfected (UIC)

Levels of the virus transgene products IFNa and Flt3L are shown in 10A and levels of IFNγ, TNFα, IL-17A, granzyme B and IL-13 are shown in 10B, FIGS. 11A-11D: Activation of surface marker expression and intracellular cytokines in endogenous tumour infiltrating T-cells in ex vivo cultures of a primary NSCLC tumour sample treated with EnAd, NG-617, NG-640 or NG-641 or left uninfected (UIC). Levels of CD4 and CD8 T-cells expressing CD25, CD69 and CD107a are shown in A & B, respectively. Levels of intracellular IFNγ and TNFα expressed by CD4 and CD8 T-cells are shown in 11C & 11D, respectively.

FIG. 12 Schematic representation of a Bispecific T cell activator antibody of the present disclosure comprising or lacking an optional decahistidine affinity tag. Ig SP: signal peptide; 10His: decahistidine affinity tag; L: GS linker; $V_L$: variable light domain; $V_H$ variable heavy domain.

FIG. 13 (A) dot blot showing the quantification of the recombinant Bispecific T cell activators. (B) shows a graph showing the ELISA results for FAP.

Figure 14B:
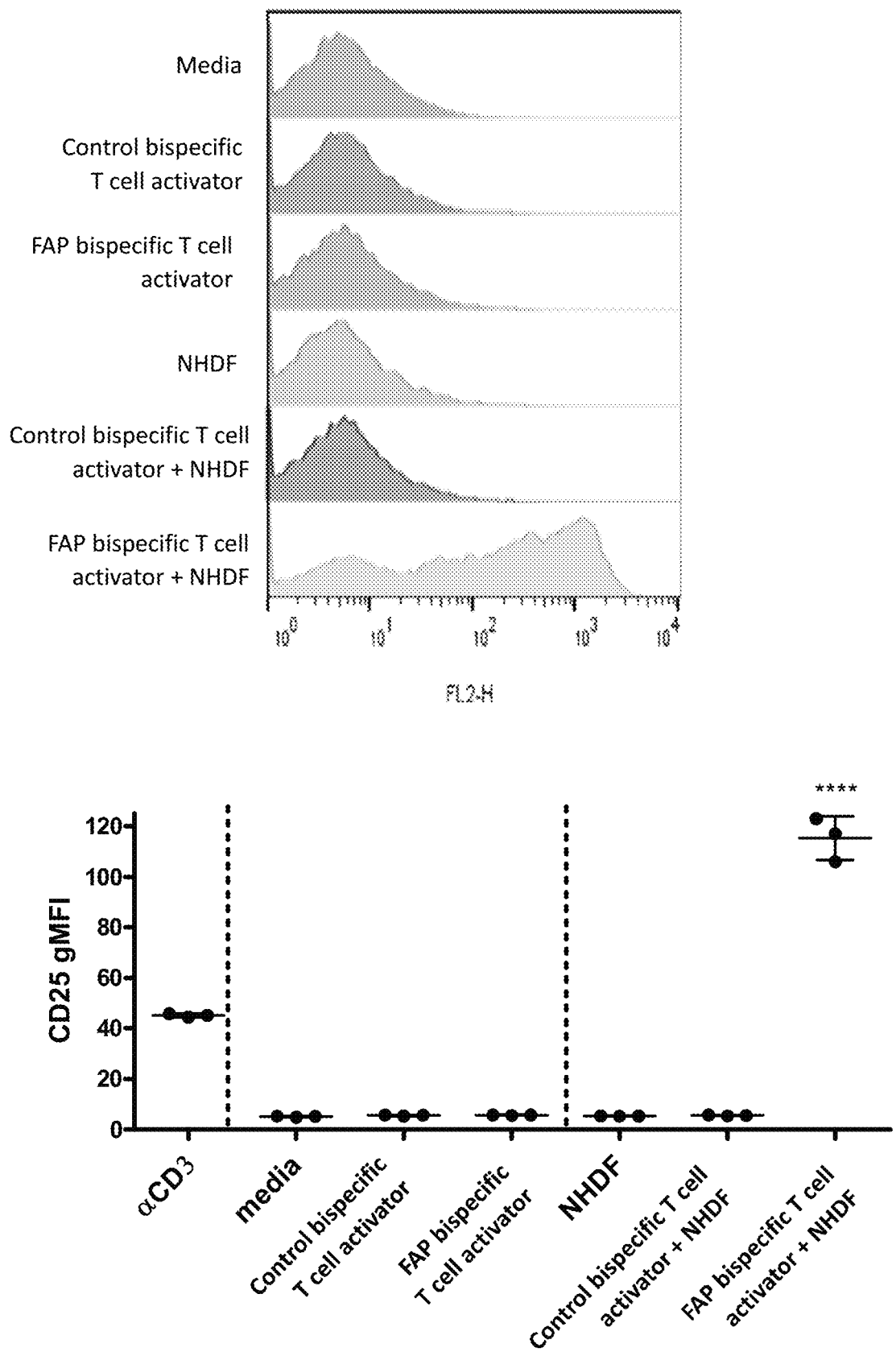
Figure 14C:
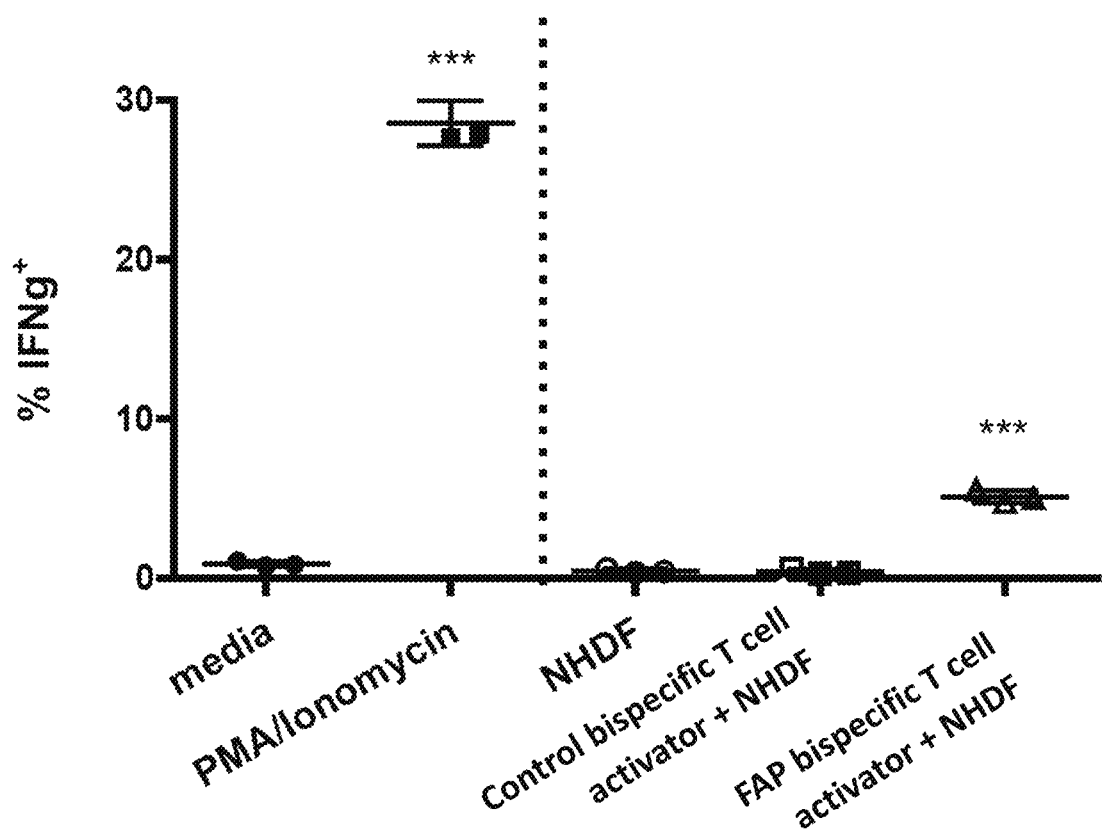
Figure 15:
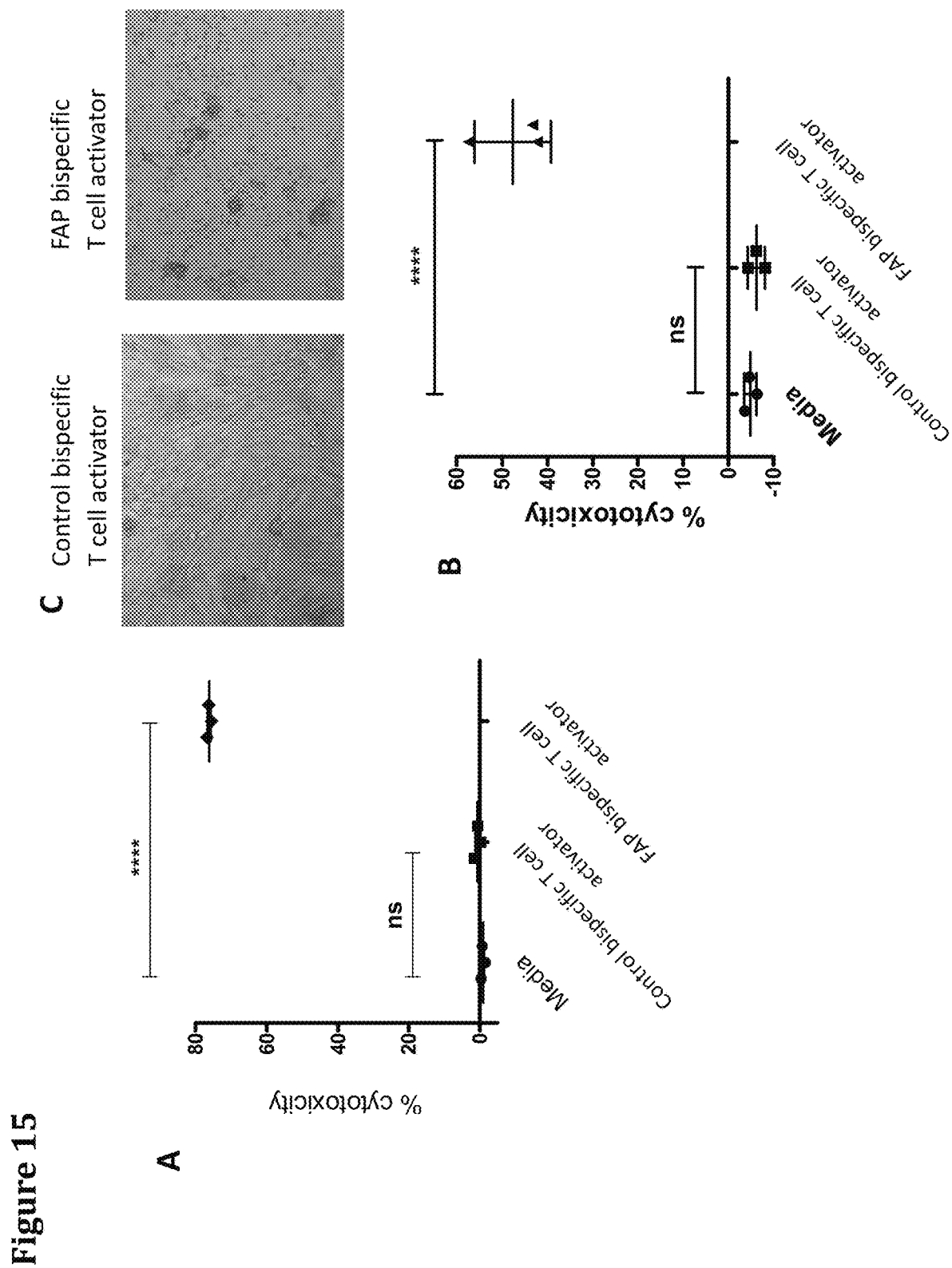

FIGS. 14A-14C shows a graph showing the expression levels of CD69 (14A) and CD25 (14B) for T cells co-cultured alone or with NHDF cells in the presence of FAP Bispecific T cell activator and control Bispecific T cell activator measured using flow cytometry. (C) graph shows the levels of IFNγ expression for T cells co-cultured alone or with NHDF cells in the presence of FAP Bispecific T cell activator and control Bispecific T cell activator measured by intracellular cytokine staining FIG. 15 (A) graph showing the results of a LDH assay showing the cytotoxicity of NHDF cells which have been co-cultured with T cells and FAP Bispecific T cell activator or control Bispecific T cell activator. (B) graph showing the results of a LDH assay showing the cytoxicity of BTC100 cells which have been co-cultured with T cells and FAP Bispecific T cell activator or control Bispecific T cell activator. (C) Images of NHDF cells after co-culture with T cells and FAP Bispecific T cell activator vs control Bispecific T cell activator.

Figure 16:
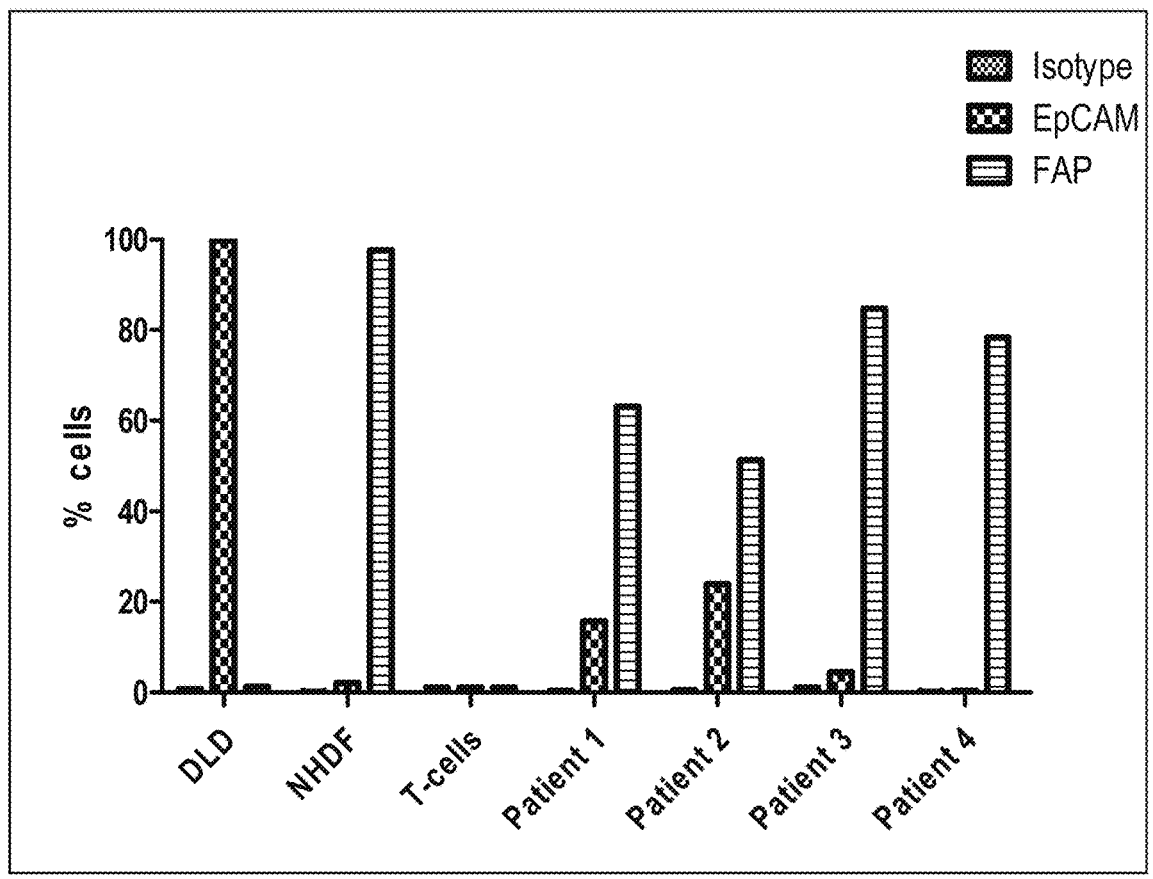

FIG. 16 (A) scatter plots showing FAP expression in multiple patient-derived cells. (B) graph showing the % of cells expressing EpCAM and FAP across multiple cells and cell lines.

Figure 17A:
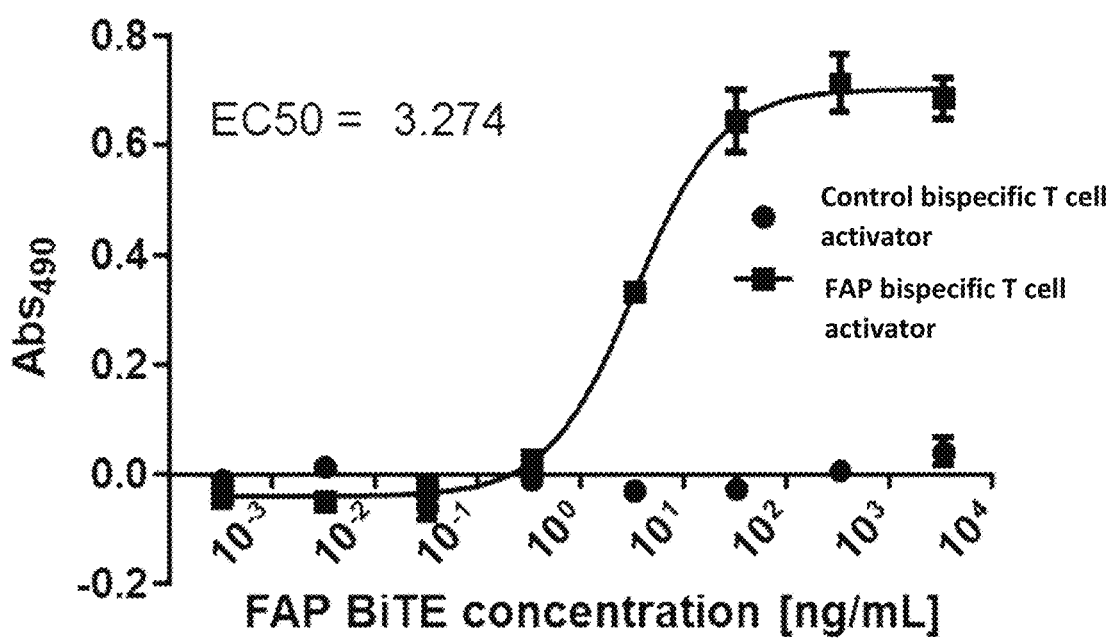
Figure 17B:
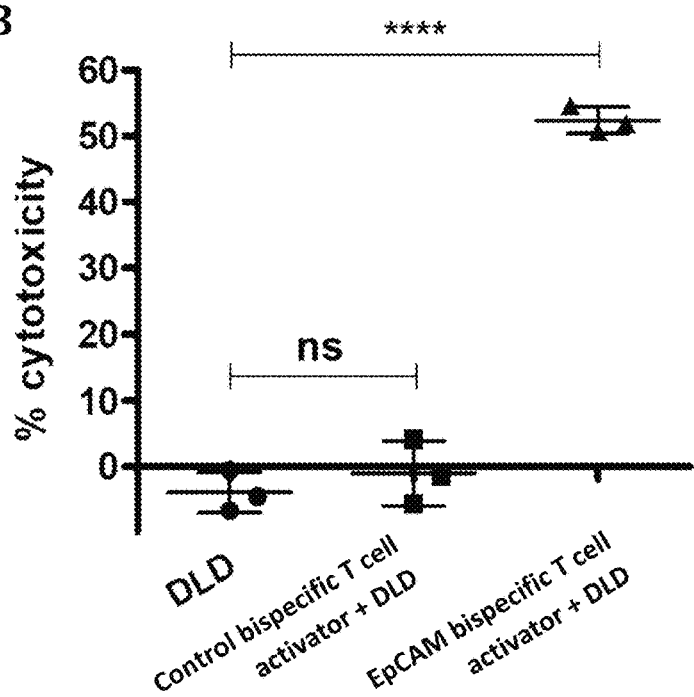
Figure 17C:
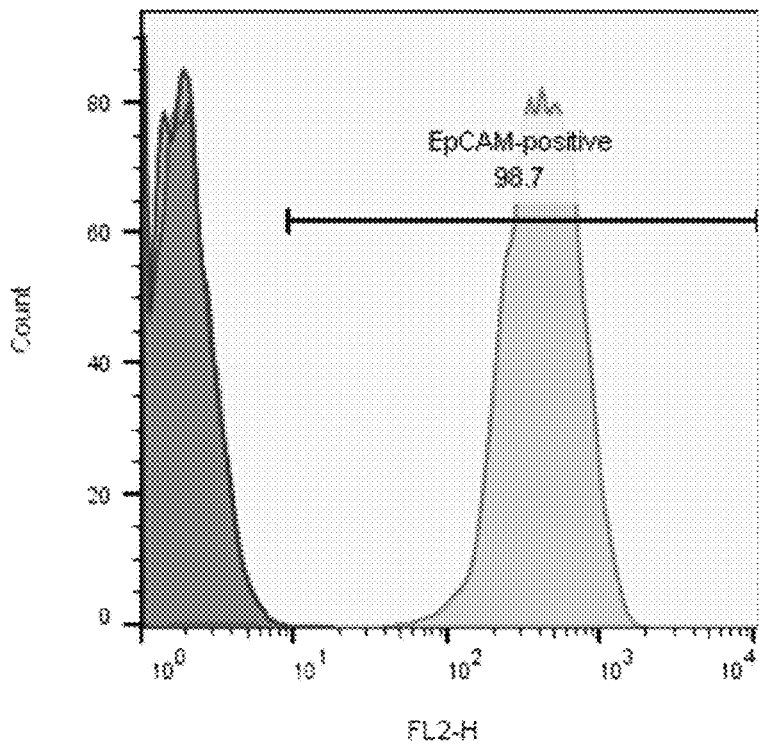

FIGS. 17A-17C (17A) graph showing the NHDF dose response for FAP Bispecific T cell activator with increasing Bispecific T cell activator concentration. Graph (17B) & (17C) showing the results of a LDH assay showing the cytoxicity of DLD cells which have been co-cultured with T cells and EpCAM Bispecific T cell activator or control Bispecific T cell activator.

Figure 18A:
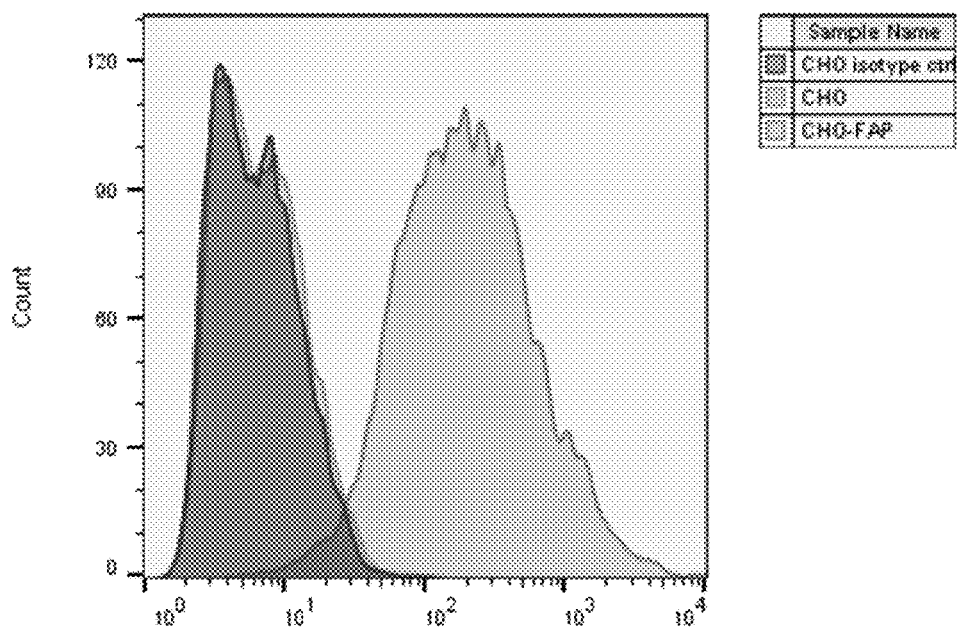
Figure 18B:
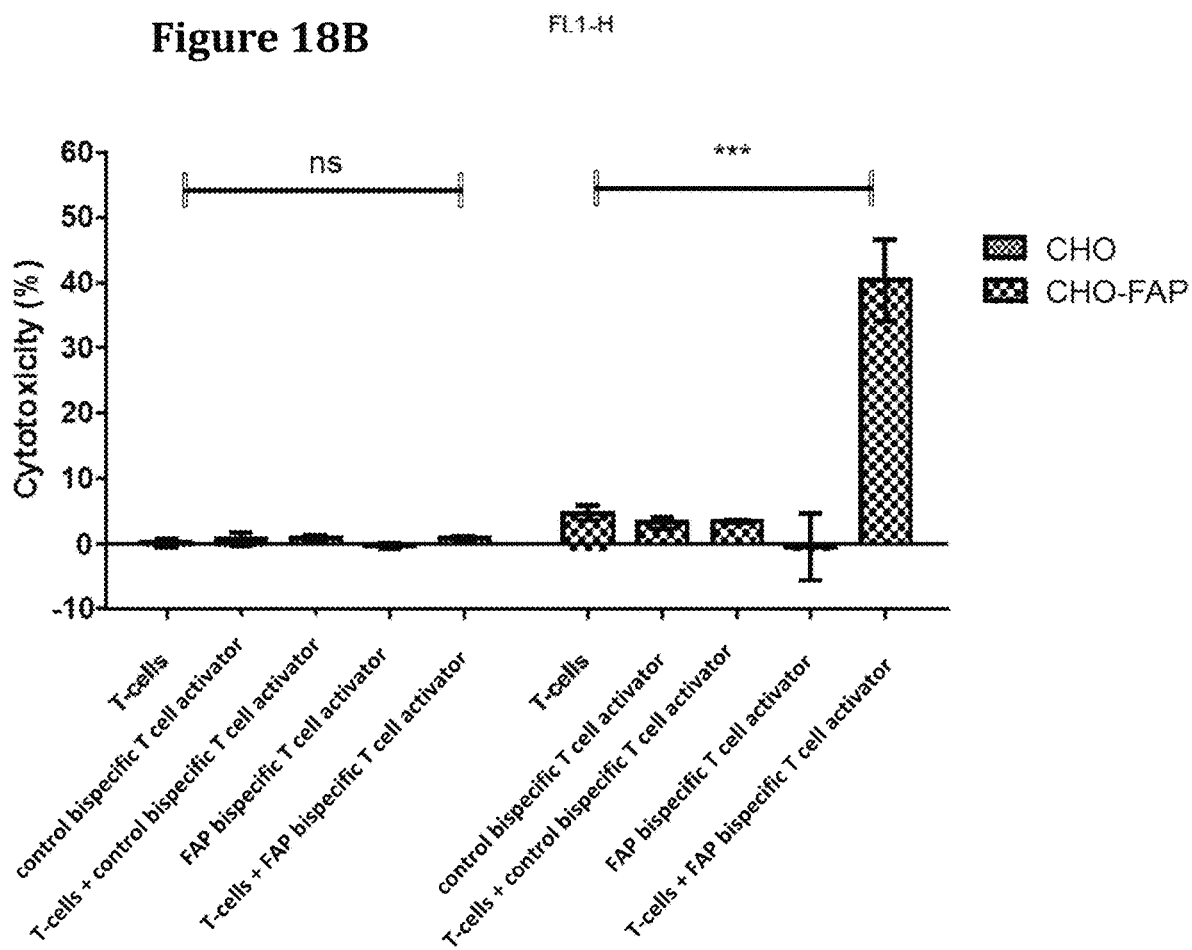

FIG. 18A-18B (18A) graph showing FAP expression in CHO cells determined by FAP or isotype control antibody and analysed by flow cytometry. (18B) shows a graph showing the results of a LDH assay showing the cytoxicity of CHO or CHO-FAP cells which have been co-cultured with T cells and FAP Bispecific T cell activator or control Bispecific T cell activator.

FIG. 19 shows a graph showing T-cell activation (based on CD69 and CD25 expression levels) by CHO vs CHO-FAP cells, analysed using flow cytometry.

Figure 20:
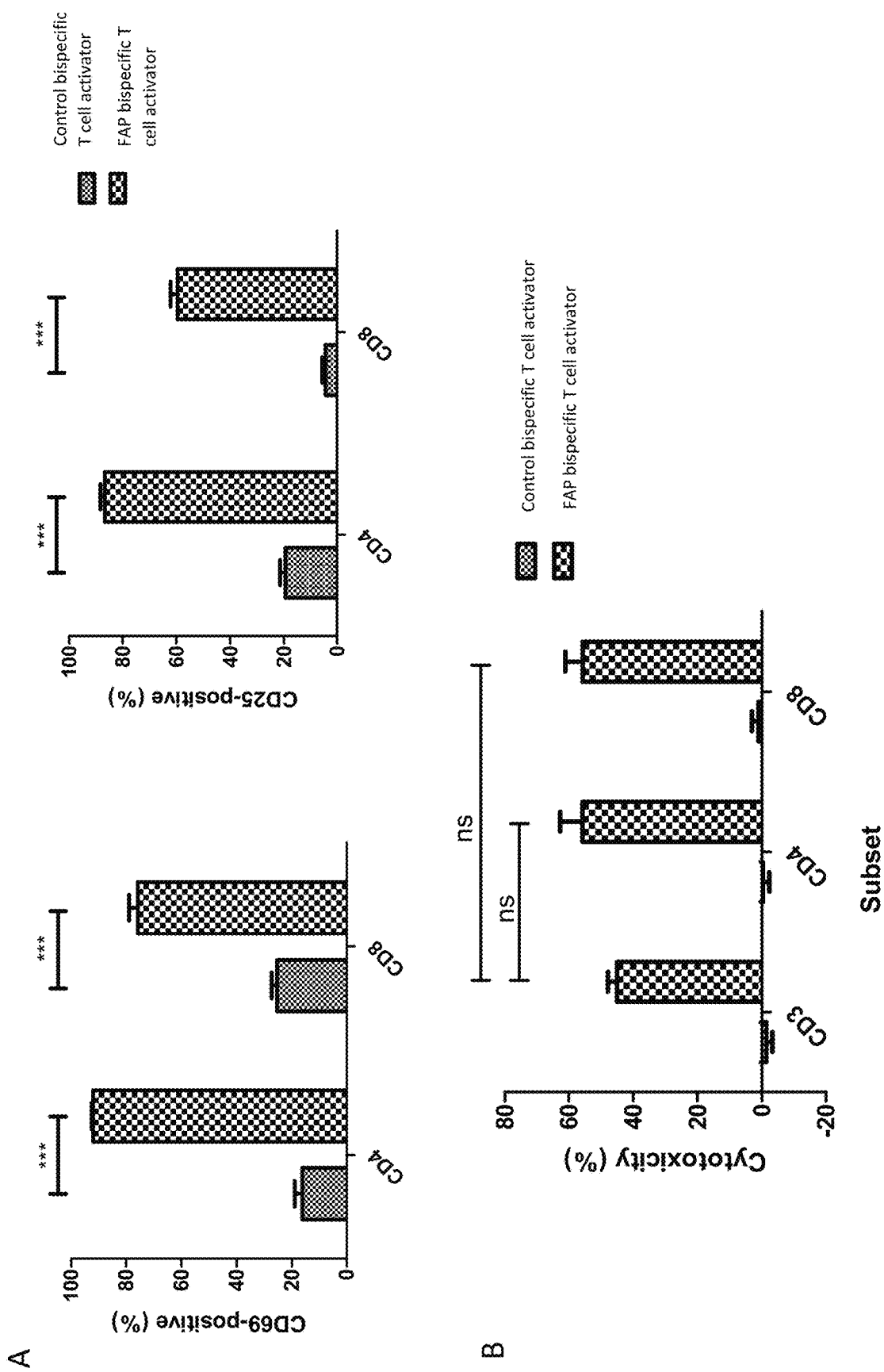

FIG. 20 (A) graph showing the ability of FAP Bispecific T cell activator to activate CD4+ or CD8+ T-cells (based on CD69 and CD25 expression levels), analysed using flow cytometry. (B) graph showing the results of a LDH assay showing the cytoxicity of NHDF cells which have been co-cultured with CD4+ or CD8+ T cells and FAP Bispecific T cell activator or control Bispecific T cell activator.

Figure 21:
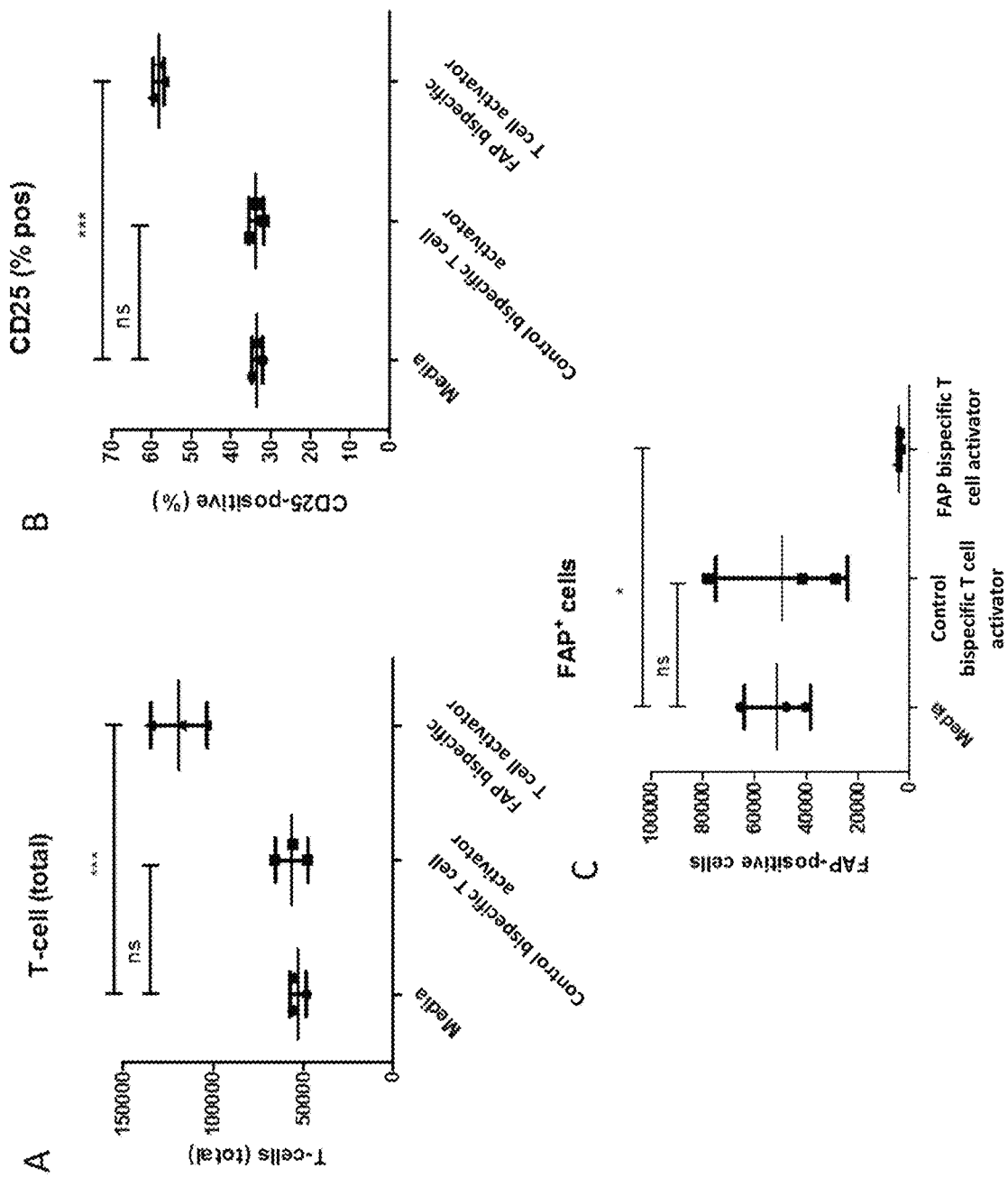

FIG. 21 (A) graph showing the number of CD3+ T cells from ascites cultured with control or FAP Bispecific T cell activator. (B) graph showing the CD25 expression levels of T cells from ascites cultured with control or FAP Bispecific T cell activator. (C) graph showing the number of FAP+ cells from ascites cultured with control or FAP Bispecific T cell activator.

Figure 22:
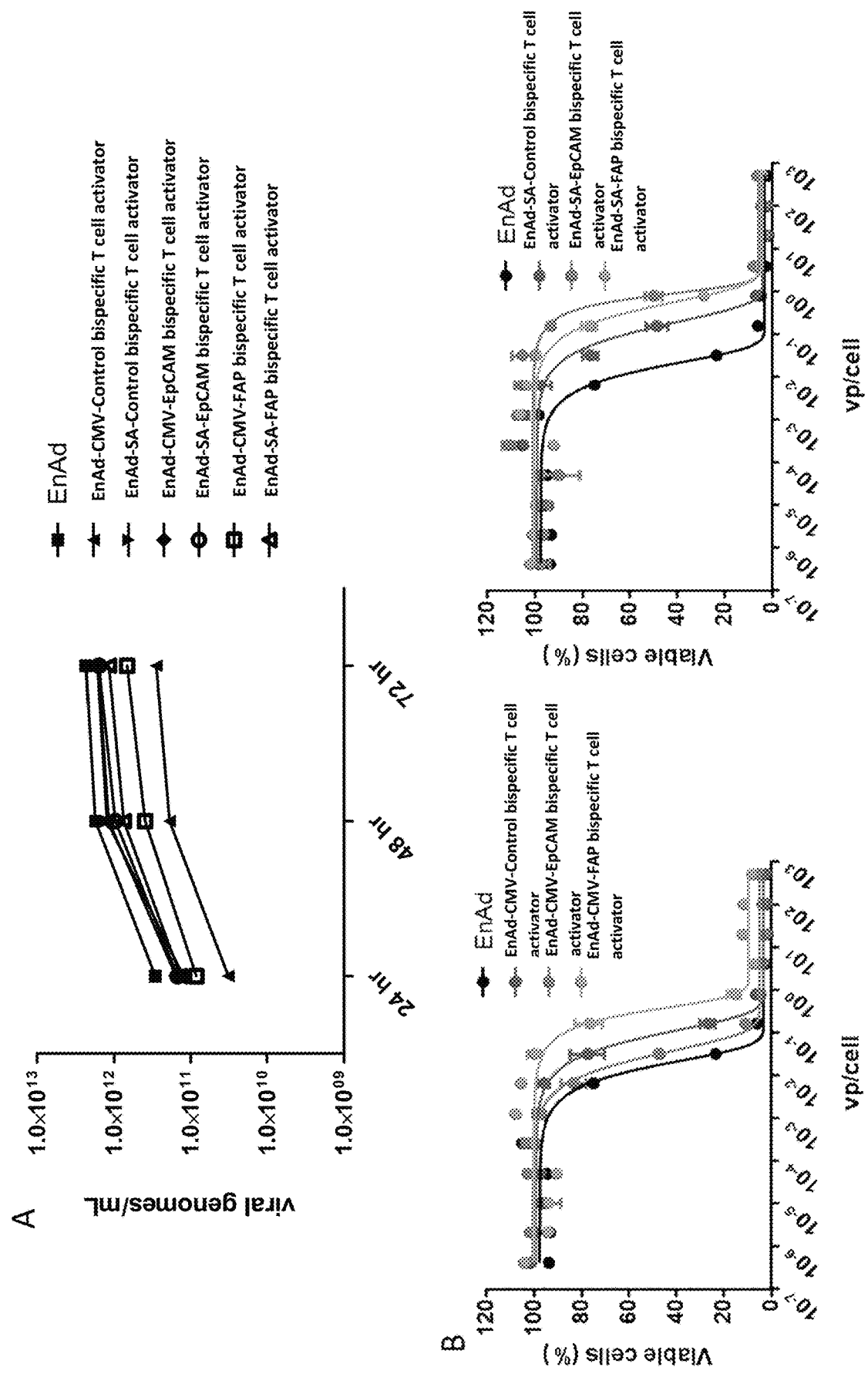

FIG. 22 (A) graph showing the quantification of the number of detected virus genomes per cell for NG-601, NG-602, NG-603, NG-604, NG-605, NG-606 and EnAd. (B) graphs showing the oncolytic activity of NG-601, NG-602, NG-603, NG-604, NG-605, NG-606 or EnAd assessed by infection of A549 cells.

Figure 23A:
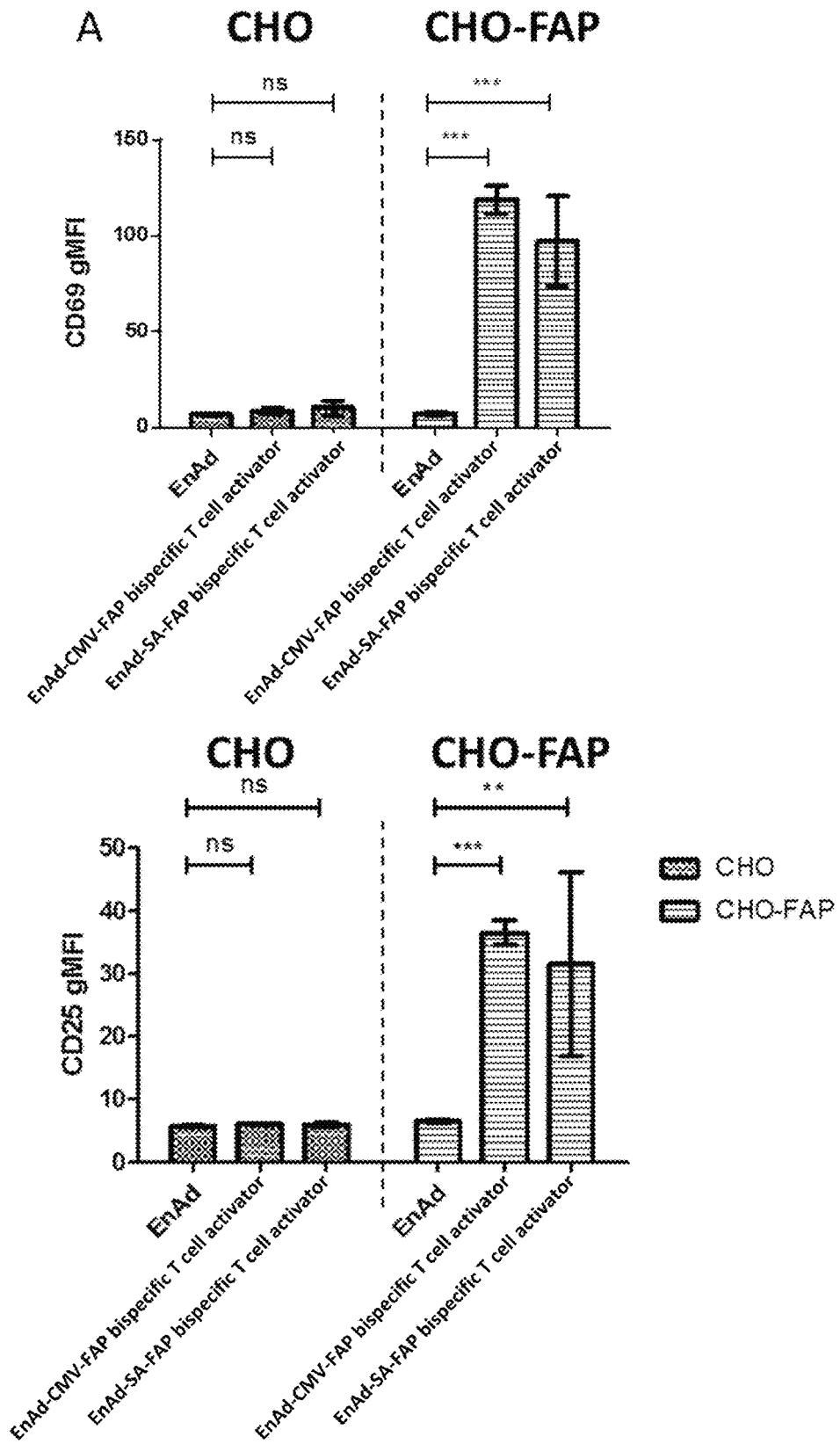
Figure 23B:
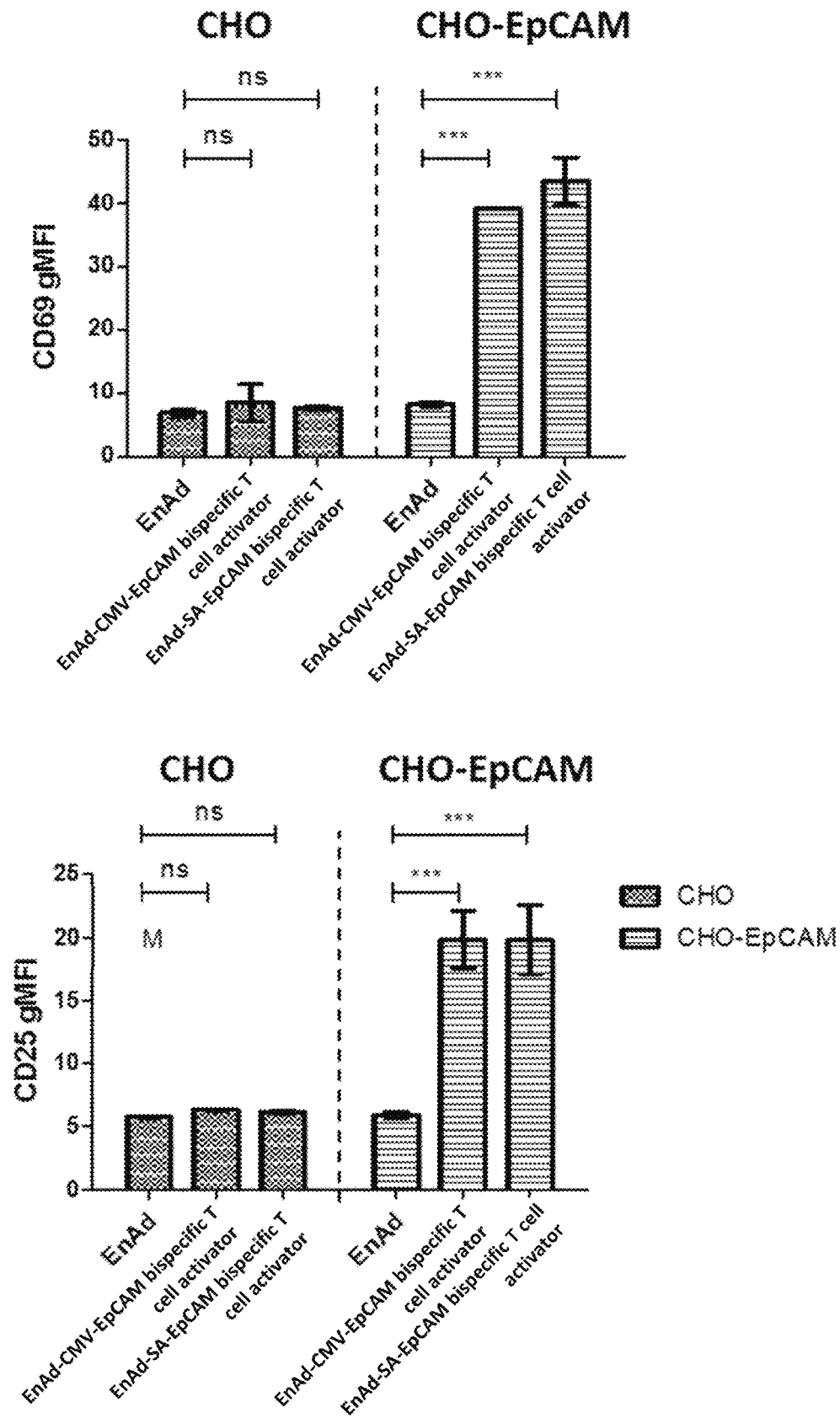

FIGS. 23A-23B (23A) graphs showing T-cell activation (based on CD69 and CD25 expression levels) by NG-601, NG-602, NG-605 and NG-606 when co-cultured with CHO-FAP, analysed using flow cytometry. (23B) graphs showing T-cell activation (based on CD69 and CD25 expression levels) by NG-601, NG-602, NG-605 and NG-606 when co-cultured with CHO-EpCAM, analysed using flow cytometry.

FIG. 24 shows graphs showing the results of experiments to determine the quantity of FAP Bispecific T cell activator produced from NG-605 and NG-606.

Figure 25:
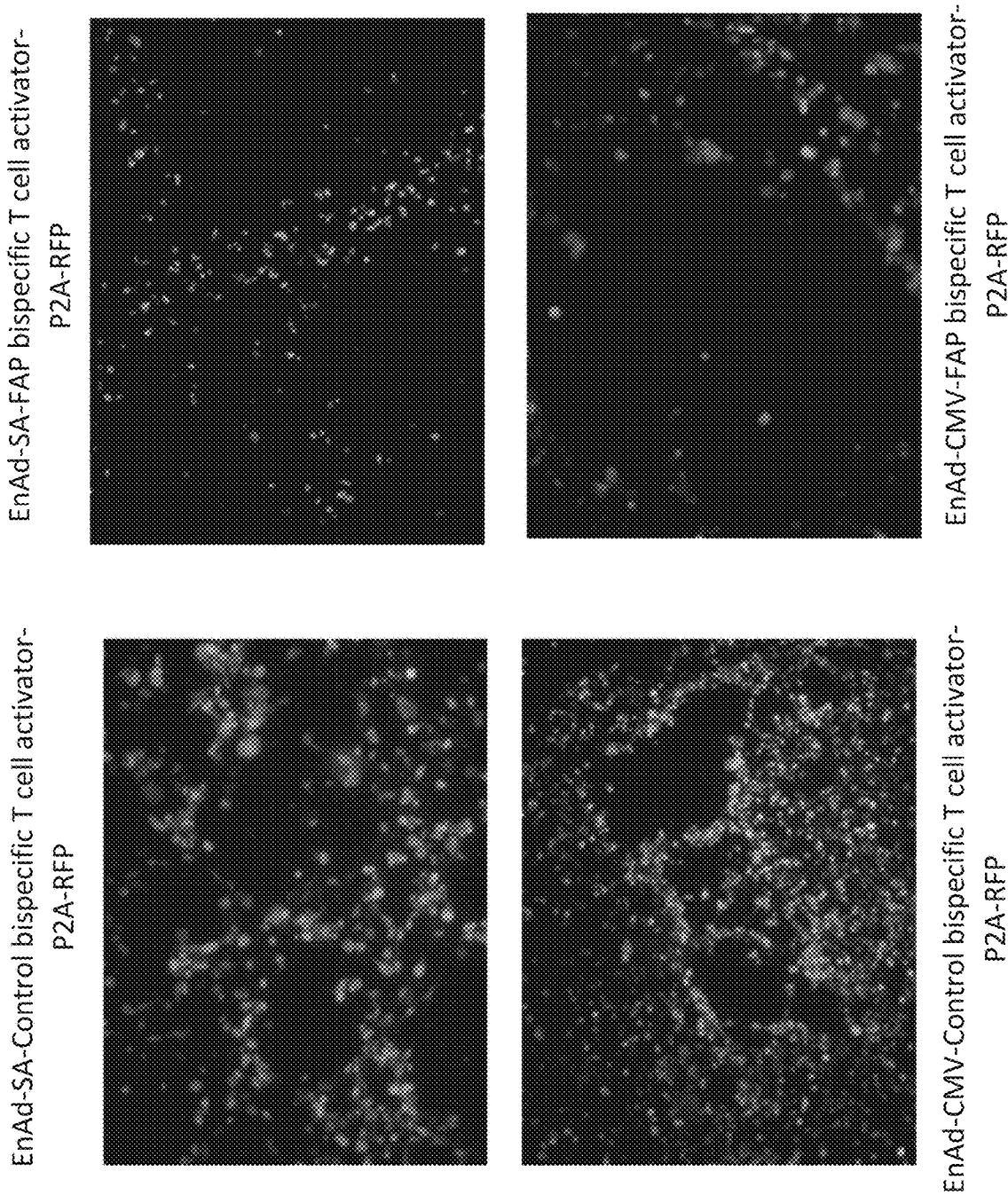

FIG. 25 shows microscopy images of Ad293 cells infected with NG-607, NG-608, NG-609 and NG-610.

Figure 26A:
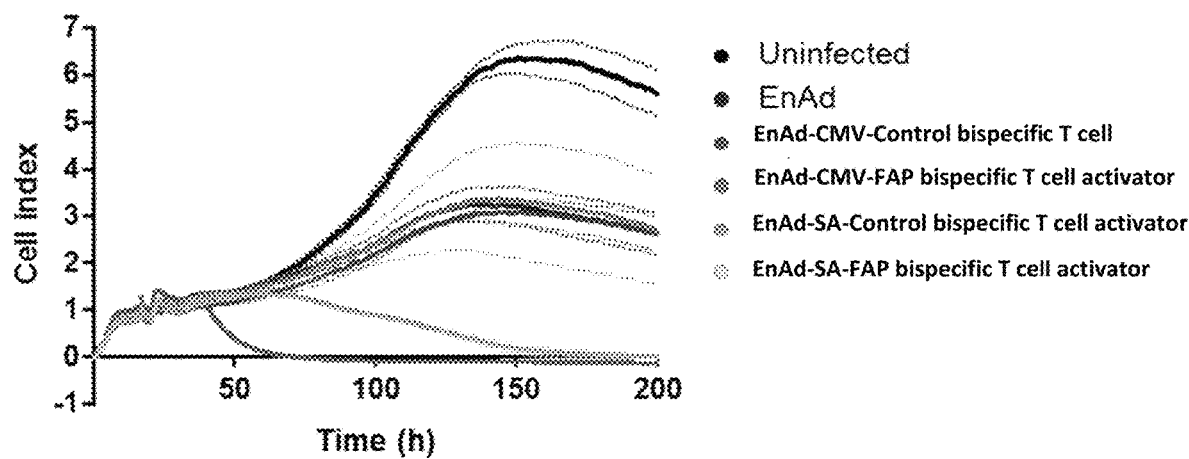
Figure 26B:
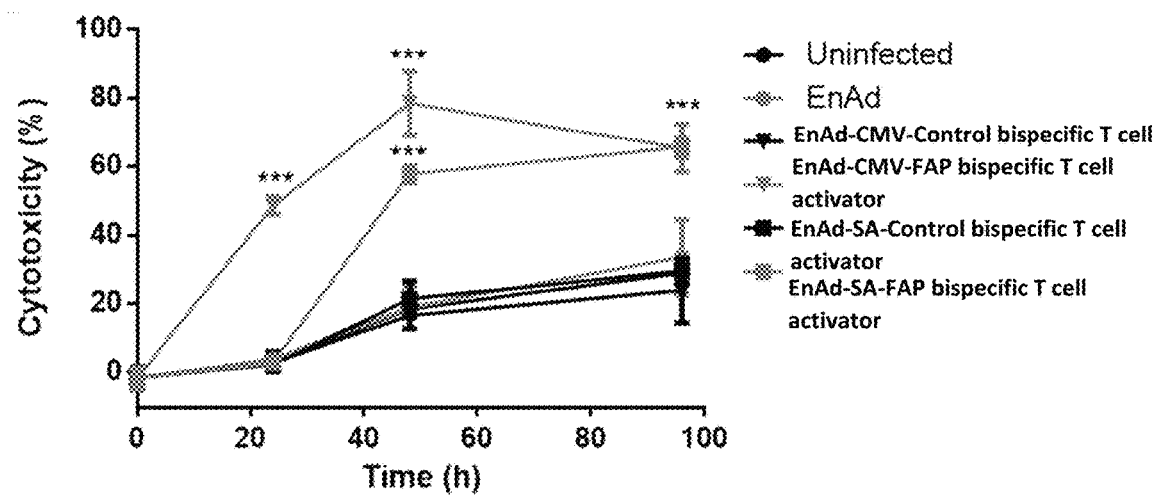

FIGS. 26A-26B (A26) graph indicating the ability of NG-603, NG-604, NG-605, NG-606 and EnAd to kill NHDF cells, analysed using XCELLigence. (26B) graph indicating the ability of NG-603, NG-604, NG-605, NG-606 and EnAd to kill NHDF cells, analysed using an LDH assay.

Figure 27:
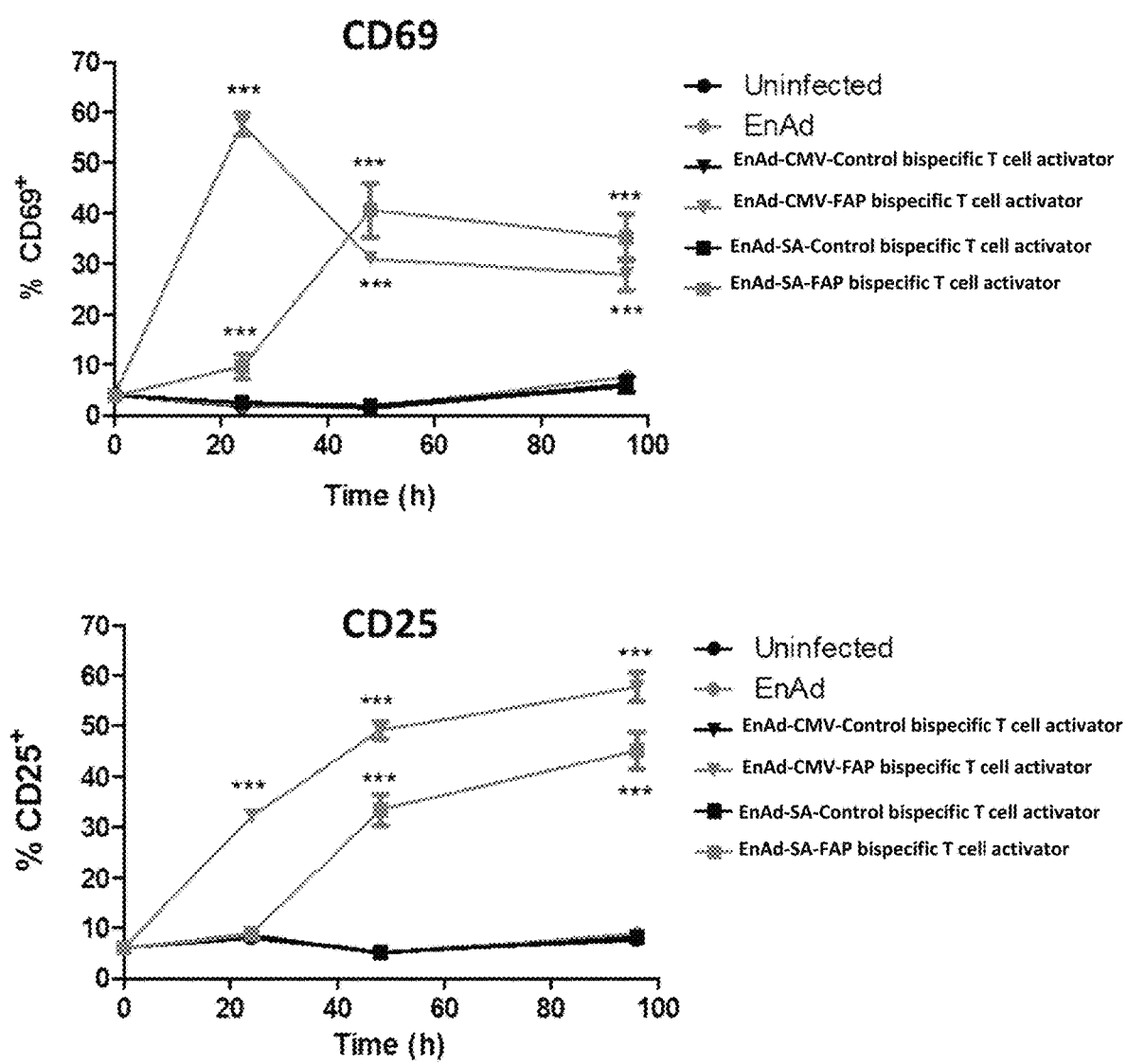

FIG. 27 shows graphs showing T-cell activation (based on CD69 and CD25 expression levels) by NG-603, NG-604, NG-605, NG-606 co-cultured with NHDF cells, SKOV and T cells, analysed using flow cytometry.

FIG. 28 (A) graph showing T-cell activation (based on CD69 and CD25 expression levels) by NG-603, NG-604, NG-605, NG-606 co-cultured with NHDF and SKOV cells vs. SKOV alone, analysed using flow cytometry. (B) graph indicating the cytotoxicity of NHDF cells infected with NG-605 and NG-606, analysed using an LDH assay FIG. 29 shows still frame images from timelapse videos of lysis of NHDF cells by recombinant FAP Bispecific T cell activator, EnAd, NG-603 or NG-605.

Figure 30:
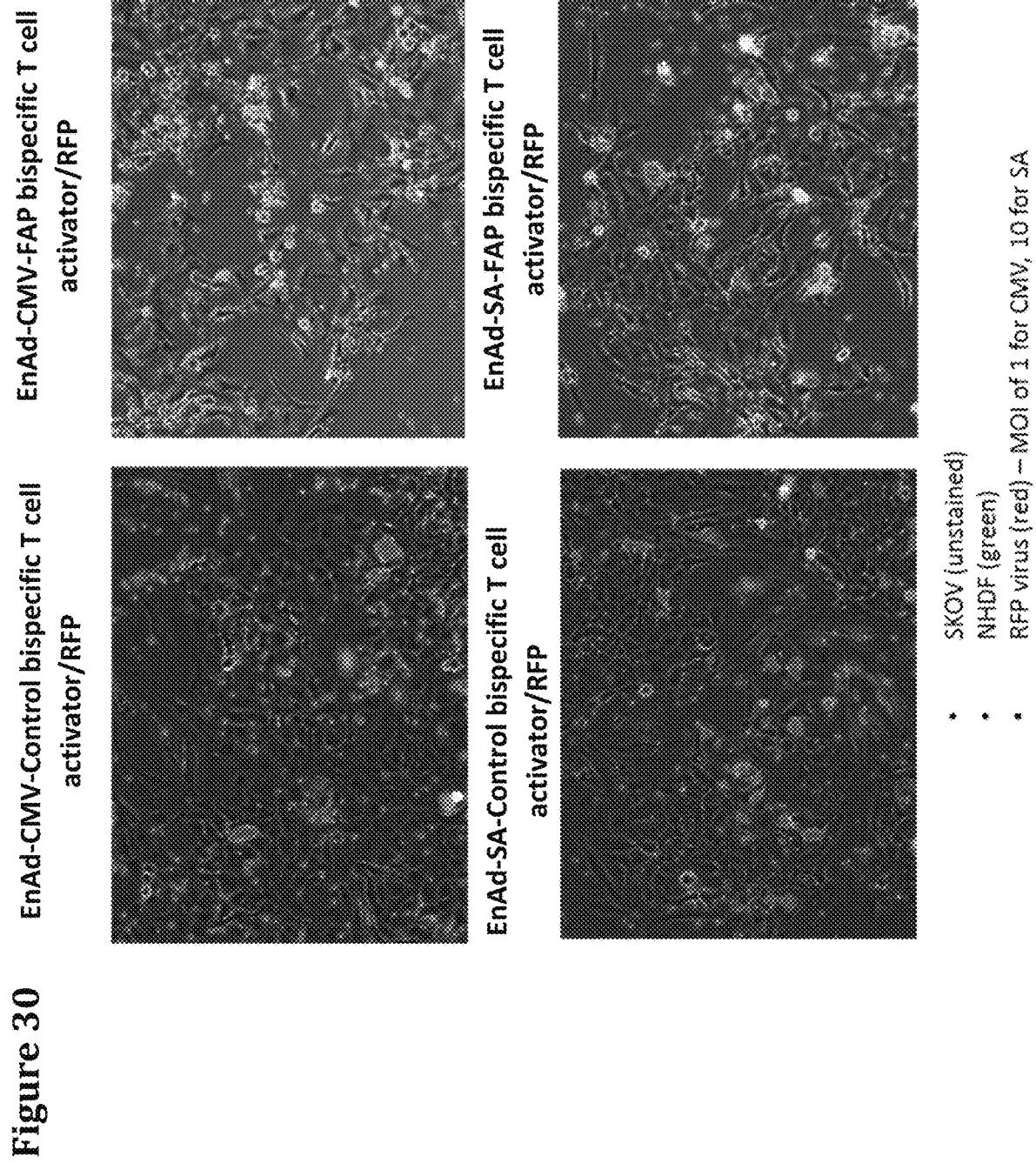

FIG. 30 shows still frame images from timelapse videos of lysis of NHDF cells by NG-607, NG-608, NG-609 or NG-610.

Figure 31:
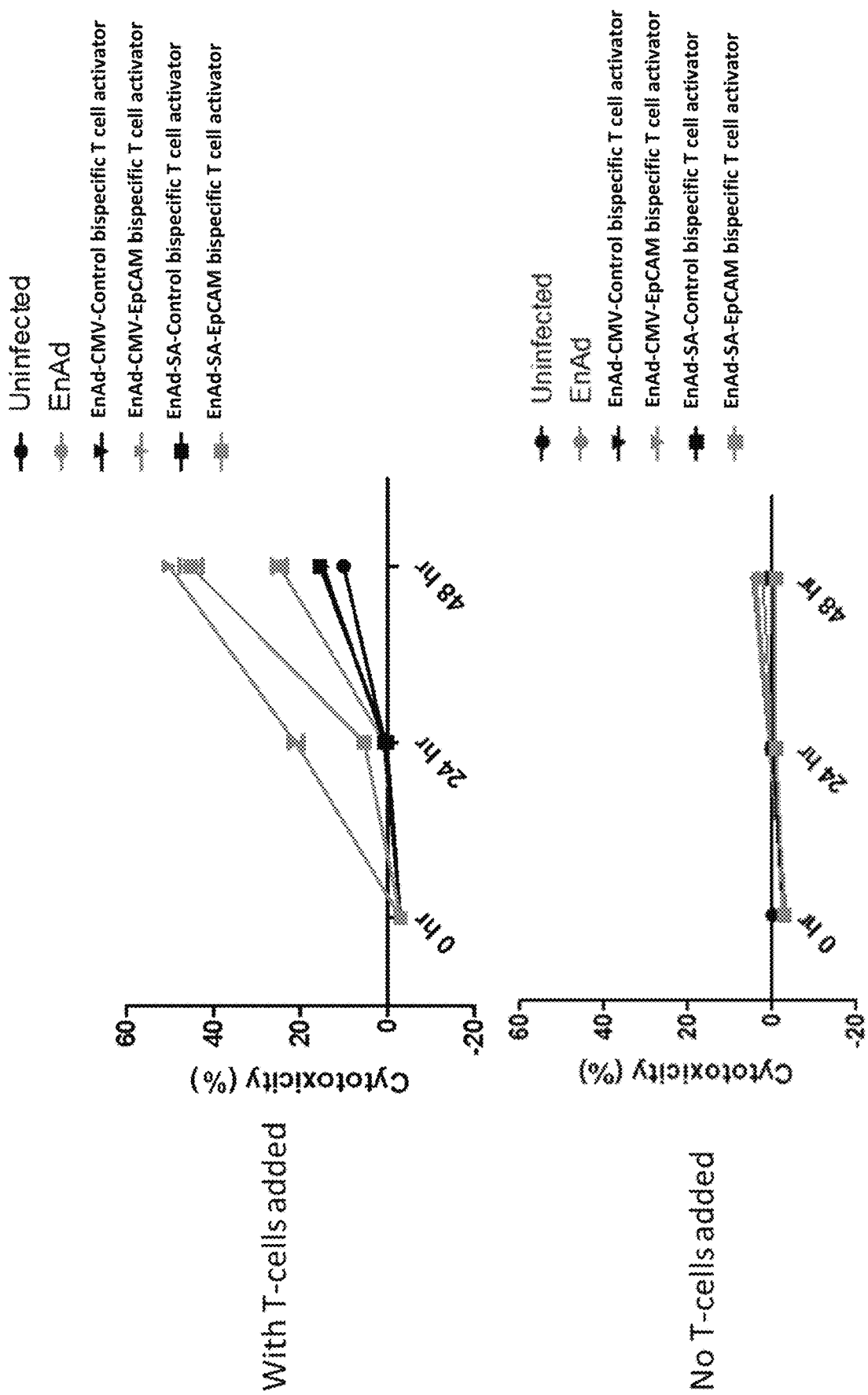

FIG. 31 shows a graph indicating the cytotoxicity of DLD cells infected with EnAd, NG-601, NG-602, NG-603 and NG-604 in the presence of T cells or absence of T cells, analysed using an LDH assay.

Figure 32:
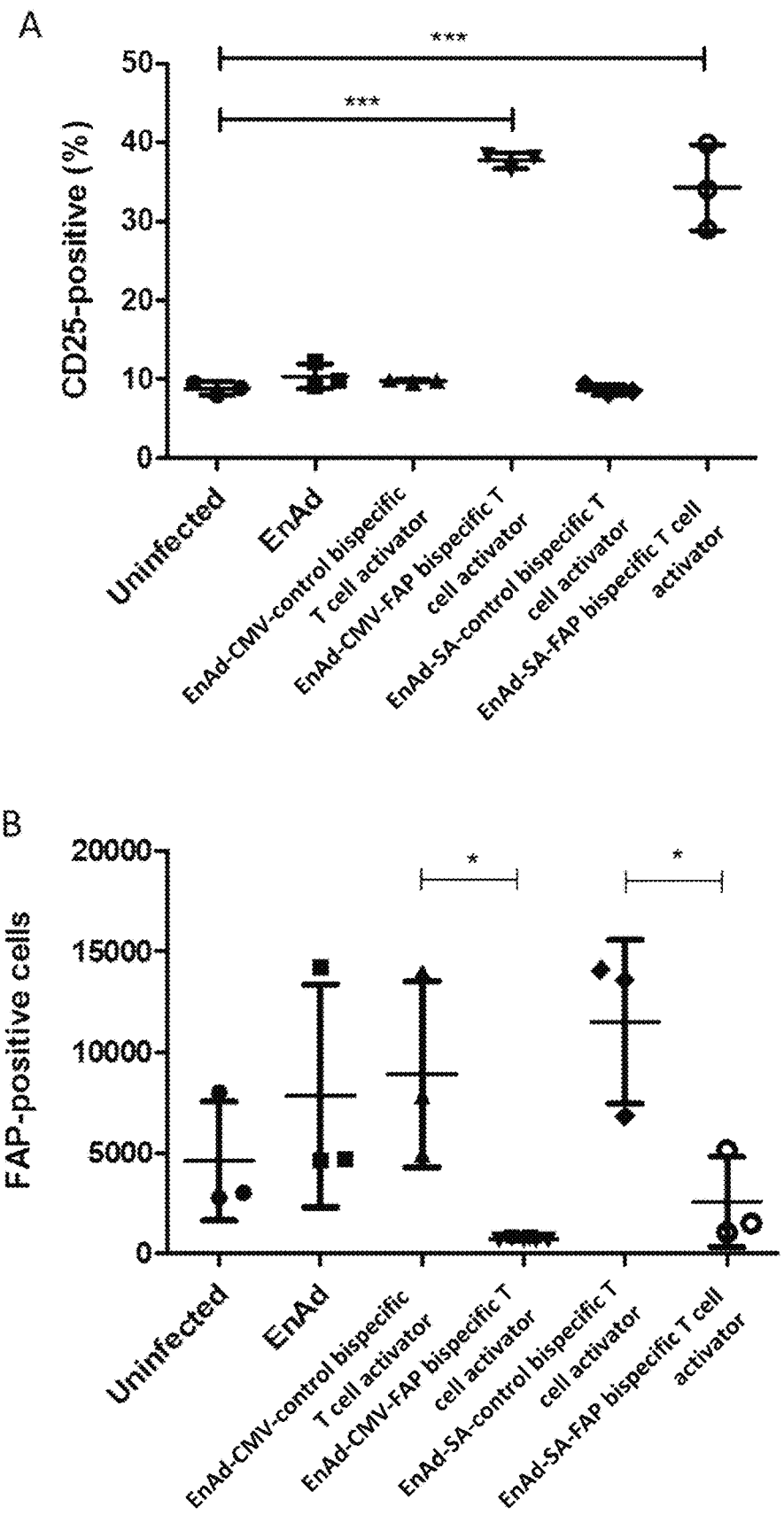

FIG. 32 (A) graph indicating the expression levels of CD25 on CD3+ T cells in ascites samples which were infected with viruses of the present disclosure. (B) graph indicating the number of FAP+ cells in ascites samples which were infected with viruses of the present disclosure.

Figure 33:
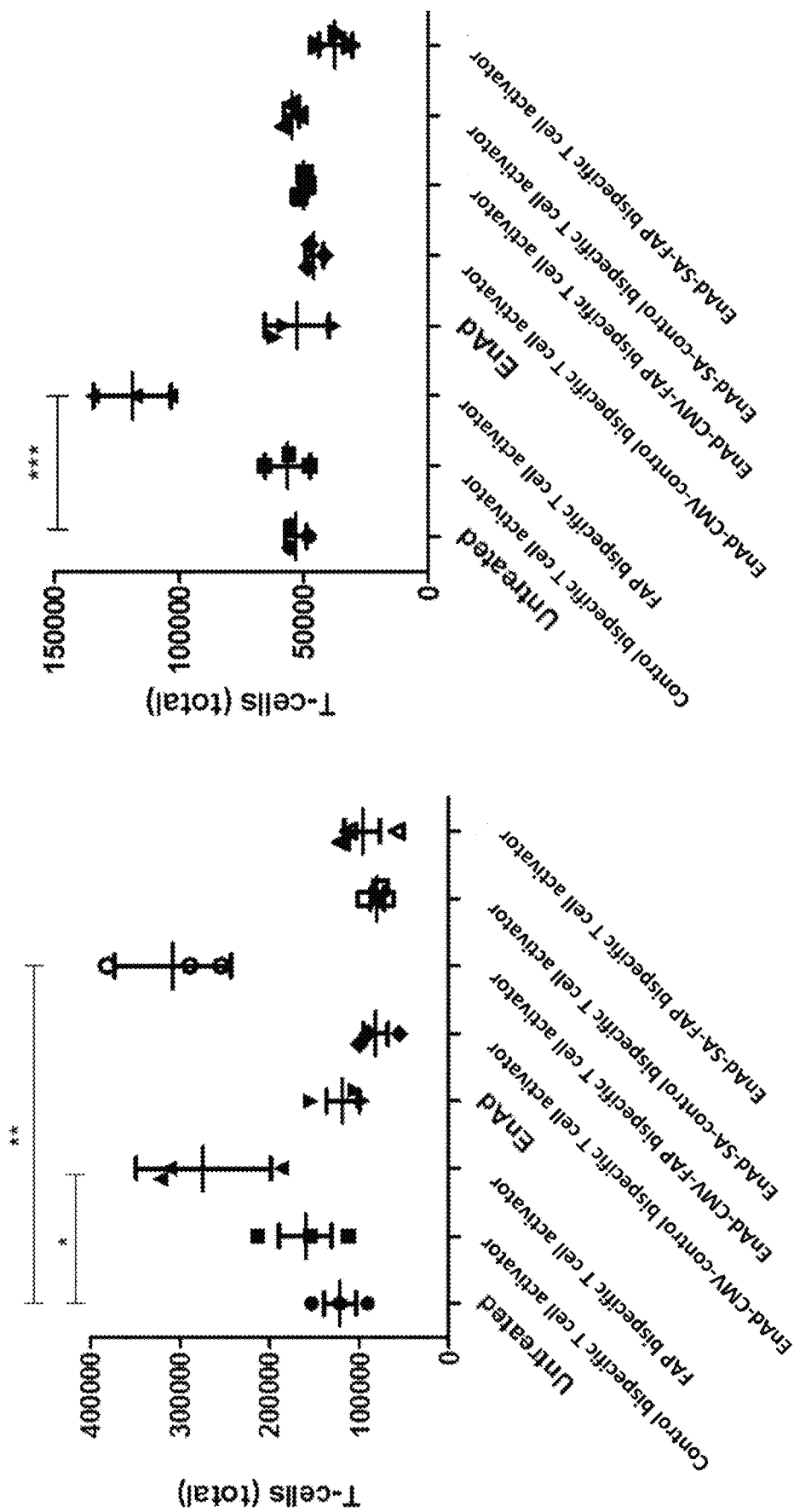

FIG. 33 shows a graph indicating the number of CD3+ T cells in ascites samples obtained from a cancer patient and infected with viruses of the present disclosure.

Figure 34:
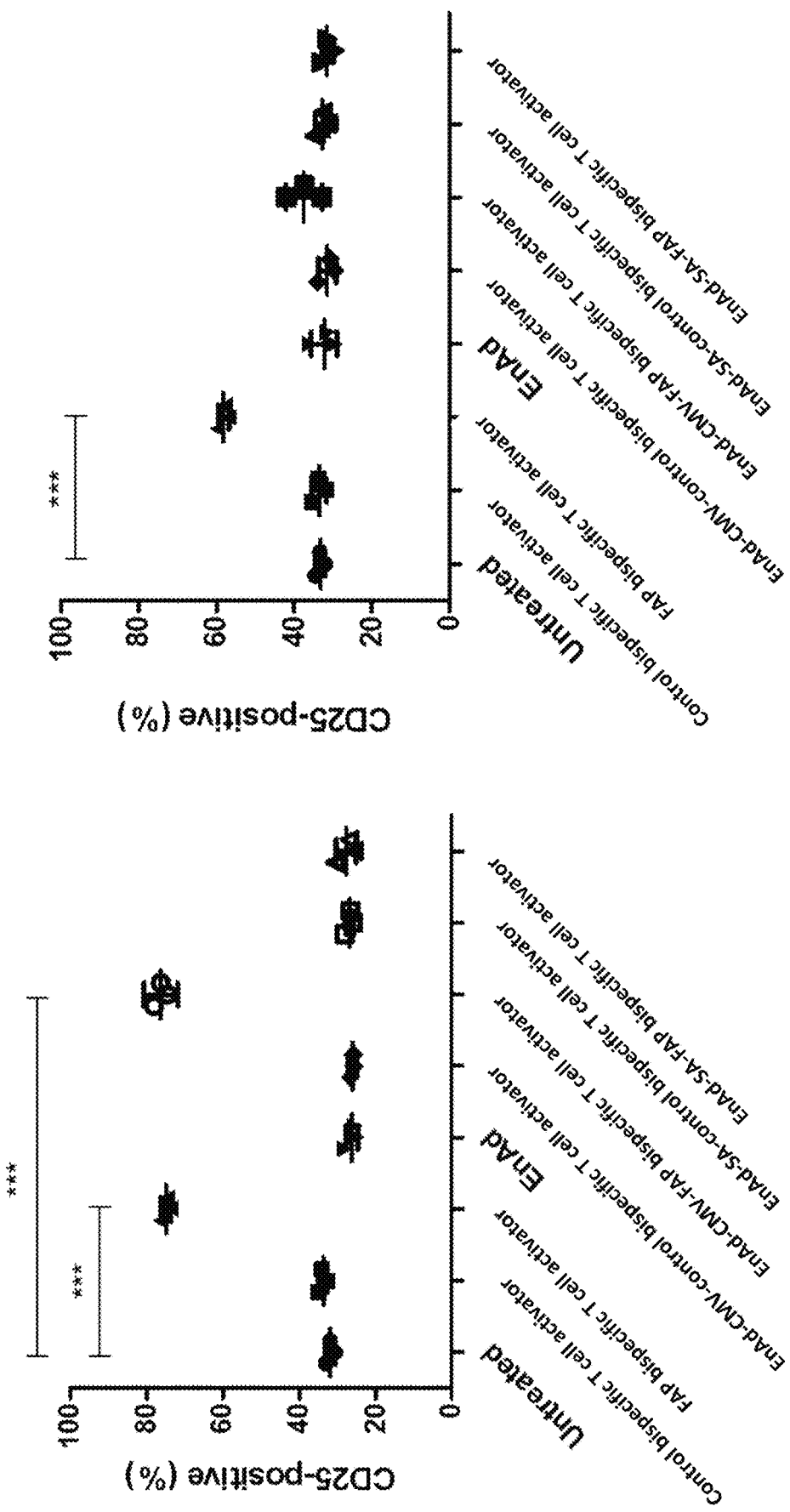

FIG. 34 shows graphs indicating the CD25 expression levels on CD3+ T cells in ascites samples obtained from a cancer patient and infected with viruses of the present disclosure.

FIG. 35 shows graphs indicating the number of FAP+ cells in ascites samples obtained from a cancer patient and infected with viruses of the present disclosure.

FIG. 36 shows a comparison of activation of T-cell cytokine production by recombinant FAP Bispecific T cell activator protein in the presence of human fibroblasts and by polyclonal activation with anti-CD3/CD28 beads. (A) IFNγ levels measured by ELISA. (B) Cytokine levels measured by cytokine bead array.

FIG. 37 FAP-targeted Bispecific T cell activator induces T-cell degranulation and specific cytotoxicity of FAP+ cells (A) Degranulation of T-cells in culture with NHDF cells (5:1) and (B) Bispecific T cell activator-containing supernatants. Degranulation was assessed by externalisation of CD107a following 6 h culture with a CD107a-specific antibody and measured by flow cytometry. CD3/CD28 Dynabeads were used as a positive control. (C) Cytotoxicity of NHDF cells after 24 h in co-culture with T-cells (1:5) and 10-fold serial dilutions of Bispecific T cell activator-containing supernatants. Cytotoxicity was assessed by release of LDH into culture supernatants. (D) Lysis of NHDF by LDH release (left) and CD25 induction on T-cells (right) was assessed after 24 h co-culture with PBMC-derived T-cells (1:5) from six healthy donors and Bispecific T cell activator-containing supernatants.

Figure 38:
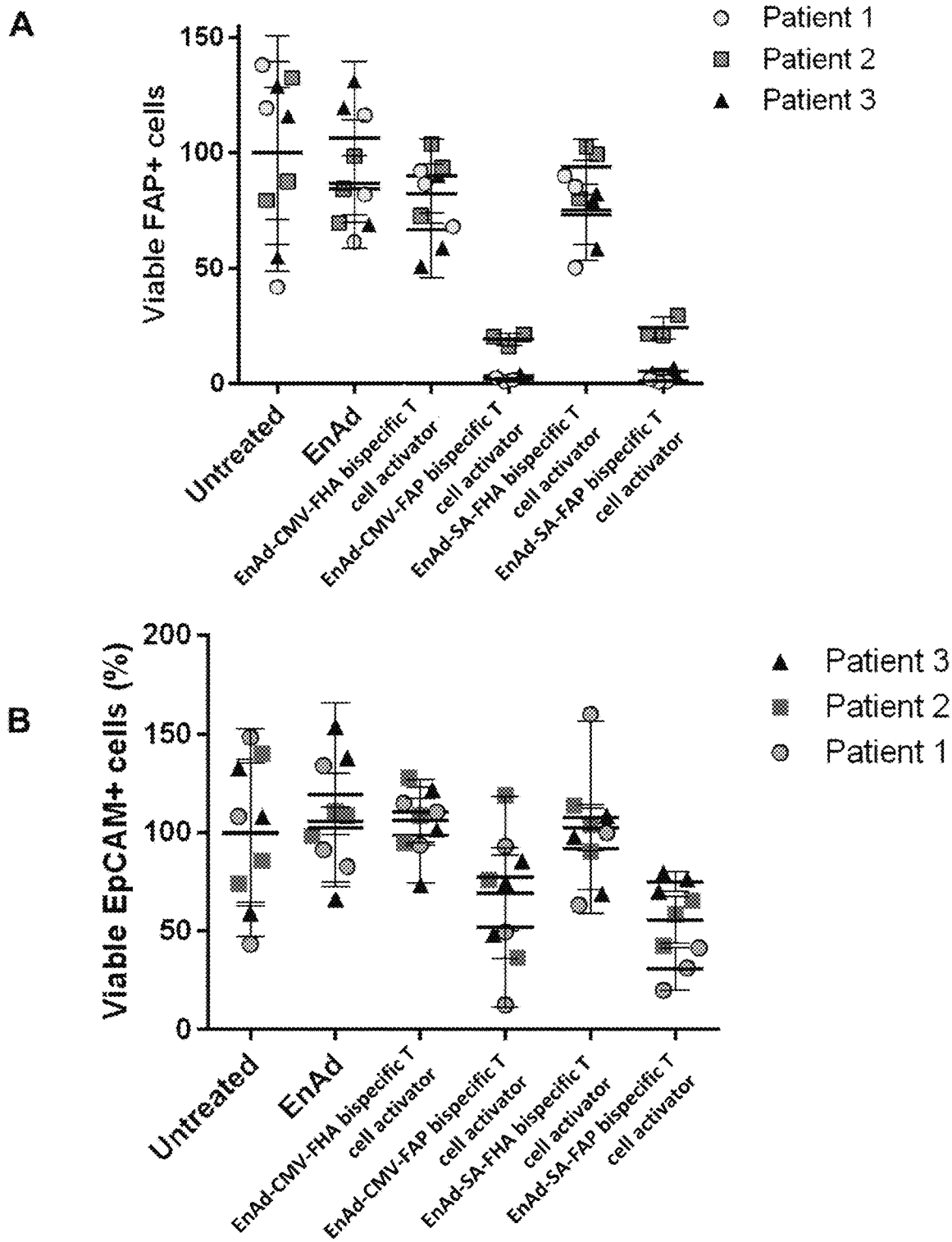
Figure 38:
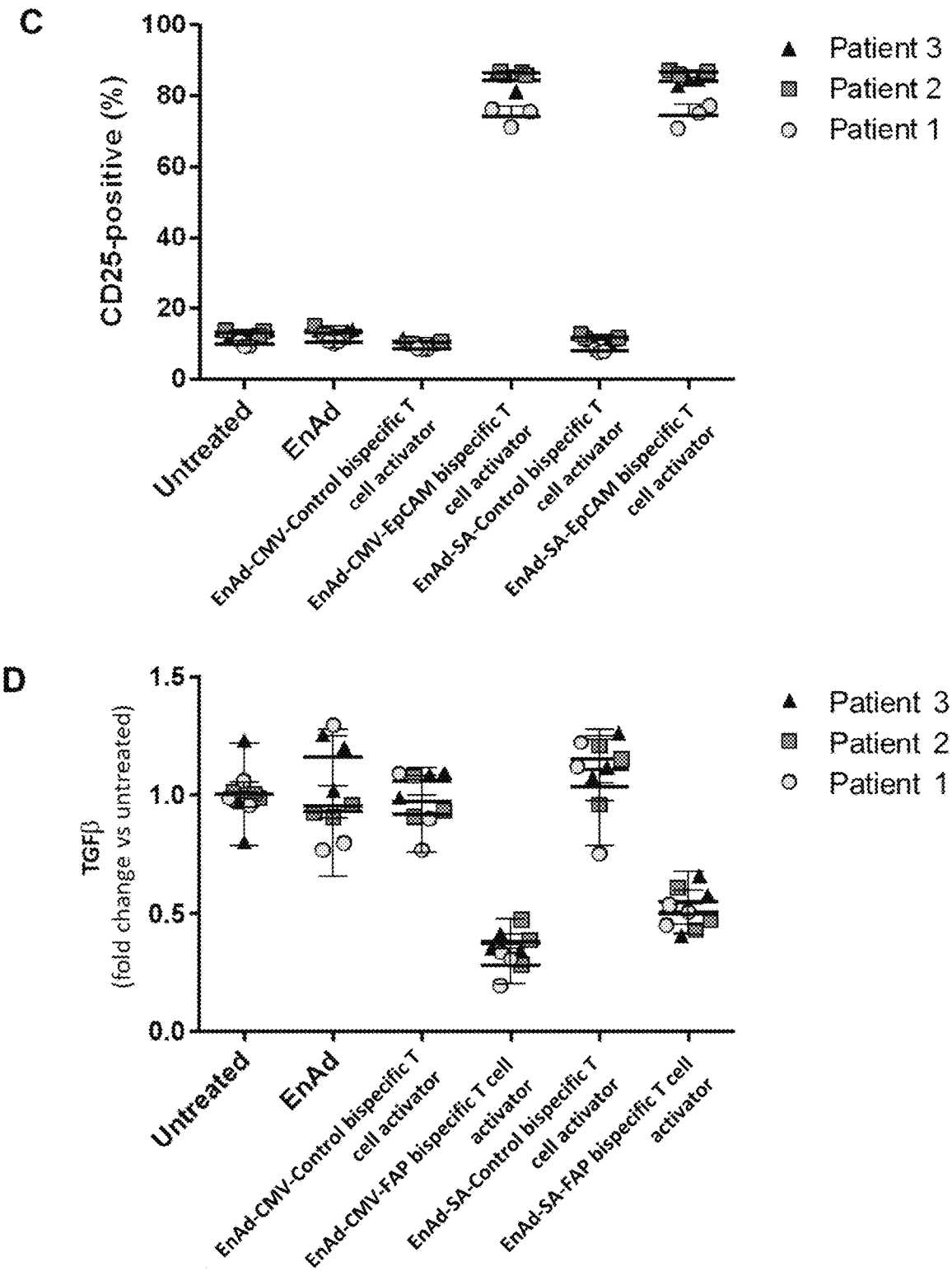

FIG. 38 EnAd expressing FAP Bispecific T cell activator selectively kills FAP+ fibroblasts and decreases TGFb in peritoneal ascites samples (A,B) Number of FAP+ fibroblasts (A) and EpCAM+ tumour cells (B) after 72 h culture with PBMC-derived T-cells and EnAd or recombinant viruses. Ascites cells were first isolated from three patients ascites and expanded ex vivo. Cell number was measured at 72 h post-infection by flow cytometry. (C) Induction of activation marker CD25 on PBMC-derived CD3 cells from (A) was measured at 72 h post-infection. (D) Levels of TGFb were measured by ELISA using supernatants harvested from (A).

Figure 39:
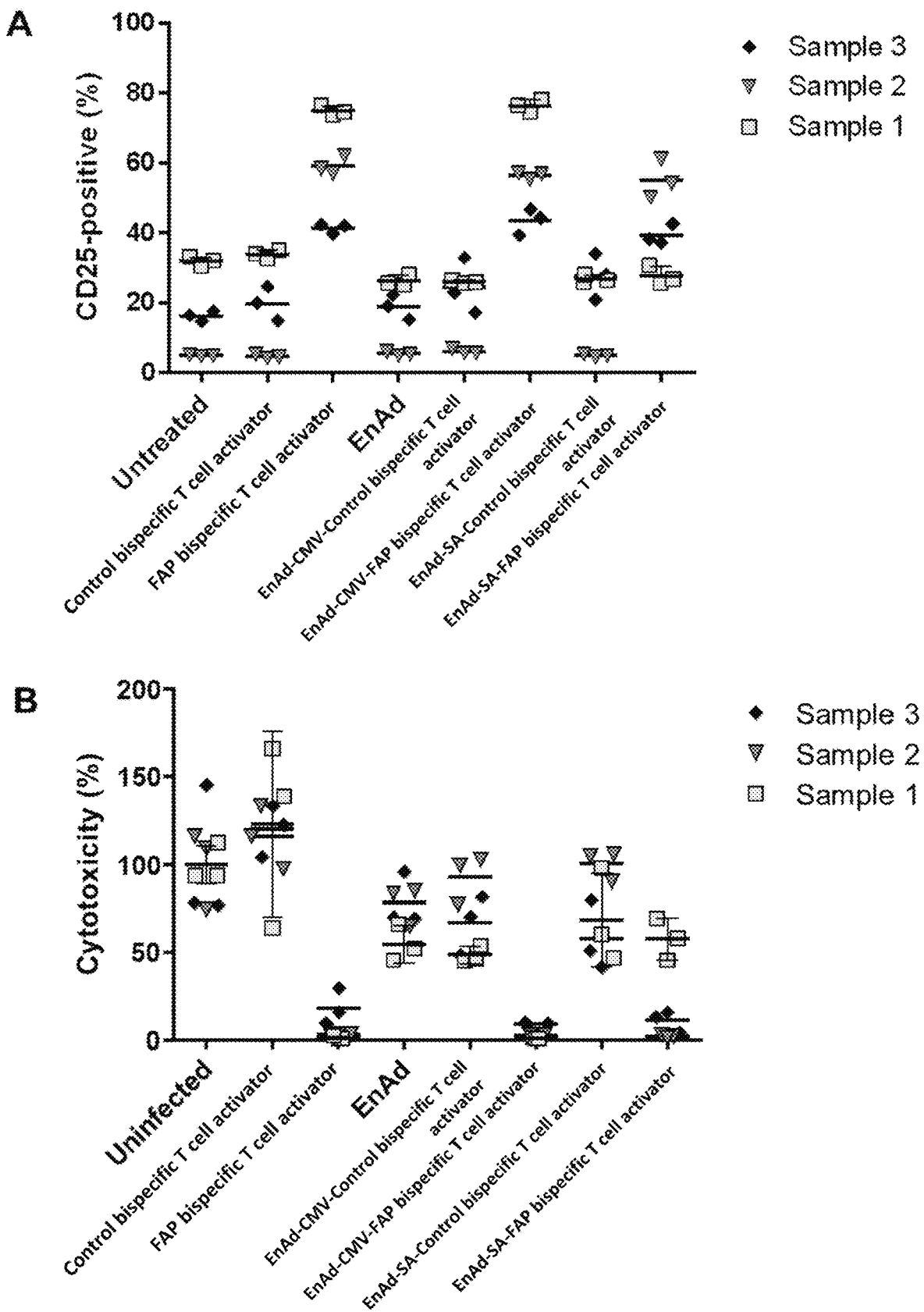

FIG. 39 shows the activation of endogenous tumor associated T-cells and associated killing of FAP+ cells in patient malignant ascites biopsy samples by FAP Bispecific T cell activator protein and EnAd-FAP Bispecific T cell activator viruses. (A) T cell activation measured by CD25 expression. (B) residual number of FAP+ cells measured by flow cytometry.

Figure 40:
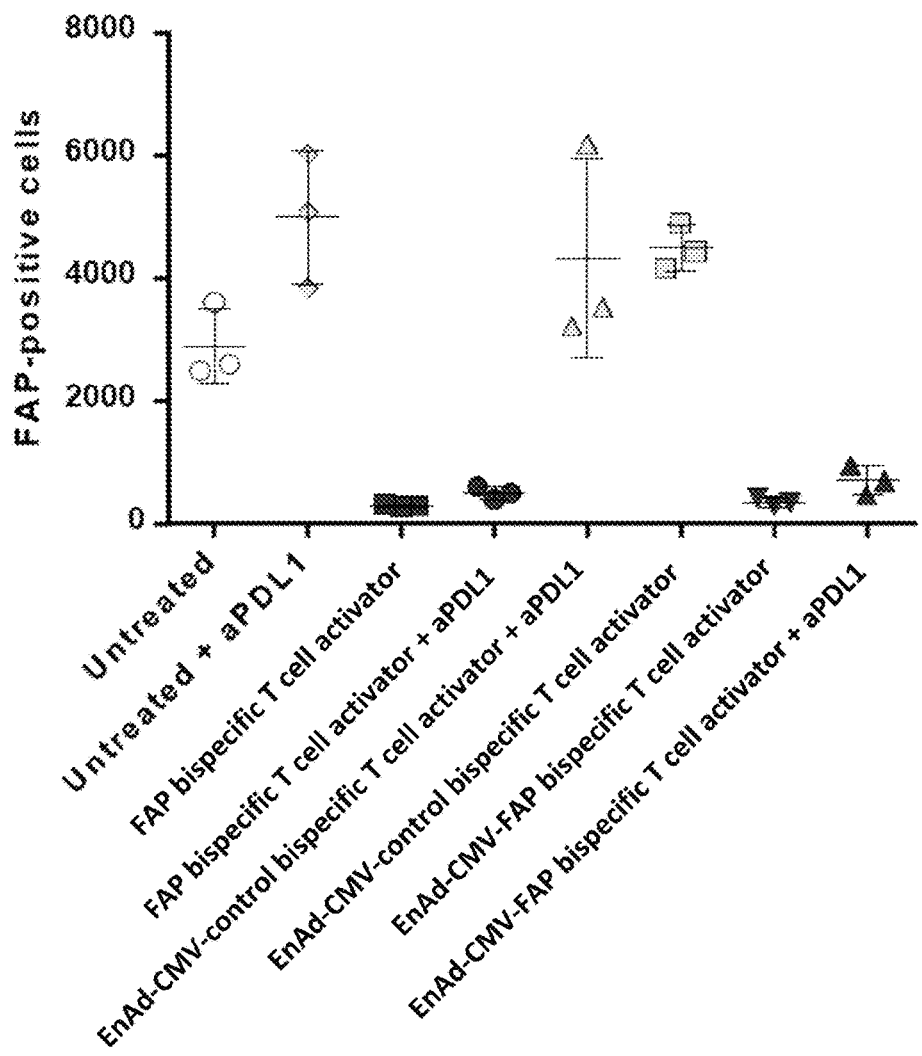

FIG. 40 Effect of PD-L1 blocking antibodies on Bispecific T cell activator-mediated T cell activation in patient sample (A) Expression of PD1 by endogenous T cells and PD-L1 on FAP+ cells following their initial isolation from peritoneal ascites was assessed by flow cytometry. (B) Unpurified total cells from peritoneal ascites were incubated in 50% fluid from the same exudate in the presence of free Bispecific T cell activator, EnAd or recombinant virus, with or without anti-PD-L1 blocking antibody. After 2 days, the total cell population was harvested, and the number of CD25+ T-cells was quantified by flow cytometry. (C) Quantity of interferon gamma in culture supernatants from (B, D) measured by ELISA. (D) The number of residual FAP+ cells in (B) was measured using flow cytometry.

Figure 41:
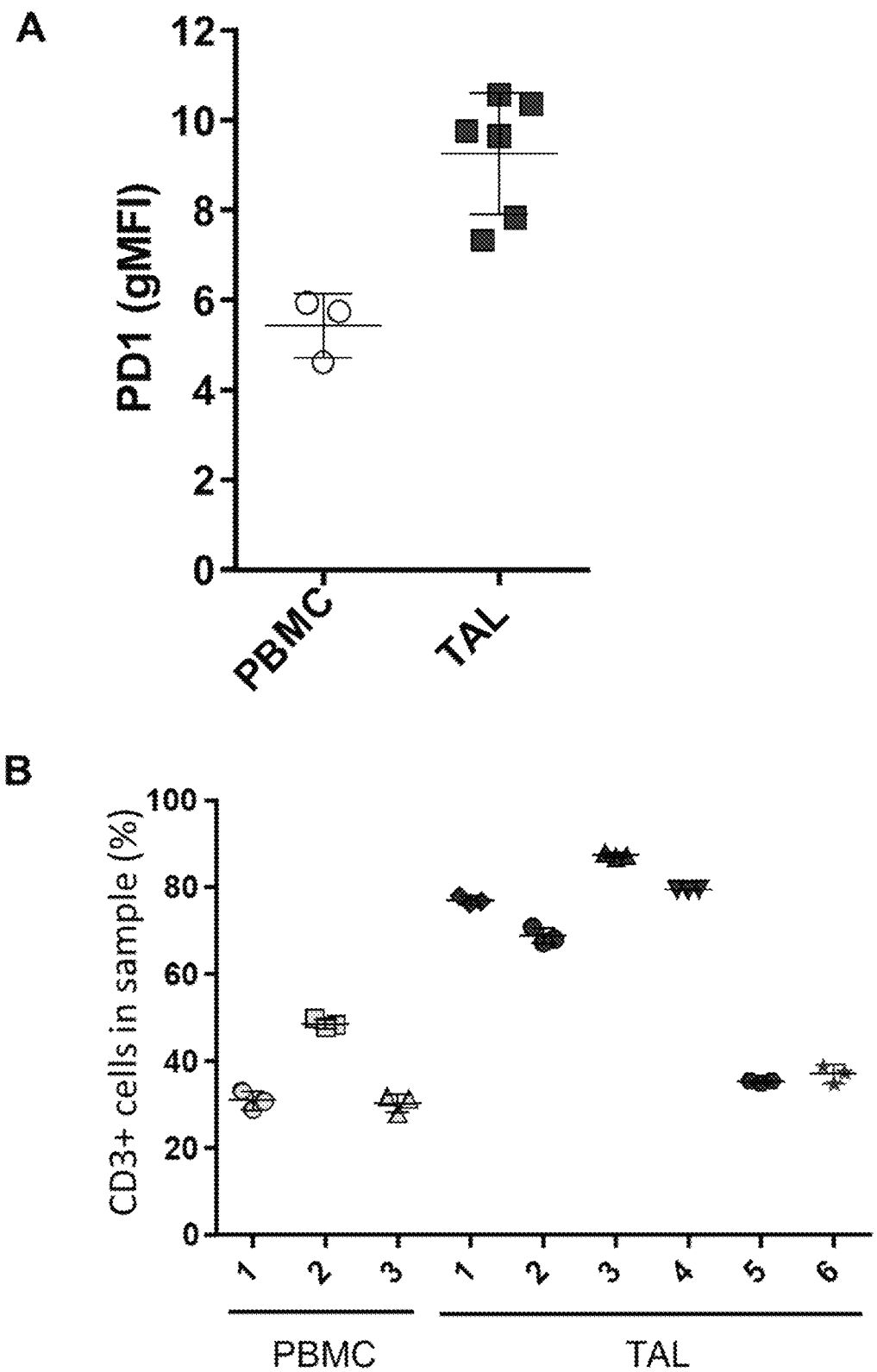

FIG. 41 EnAd expressing Bispecific T cell activators activate and redirect T-cells from patient biopsy samples to lyse NHDF fibroblasts (A) The expression of PD-1 by endogenous T cells following isolation from healthy donors or malignant exudate cancer biopsy samples. PD-1 expression was measured by flow cytometry. (B) The proportion of CD3$^+$ cells within the unpurified cell population of PBMC and cancer biopsy samples as measured by flow cytometry. (C) Levels of interferon gamma measured by ELISA in culture supernatants harvested from (B) at 120 h post-treatment (D) Viability of NHDF fibroblasts were monitored in real time over 130 h by xCELLigence cytotoxicity assay in co-culture with PBMC or total cancer biopsy cells (1:5) and Bispecific T cell activator-containing supernatant.

FIG. 42 shows the effect of immunosuppressive ascites fluid samples on FAP Bispecific T cell activator- and anti-CD3/CD28 bead-mediated activation of PBMC T-cells. (A) PBMC T cells activated with anti-CD3/Cd28 Dynabeads. (B) PBMC T cells activated with control or FAP Bispecific T cell activators in the presence of NHDF cells. NS: normal serum, A: peritoneal ascites.

Figure 43:
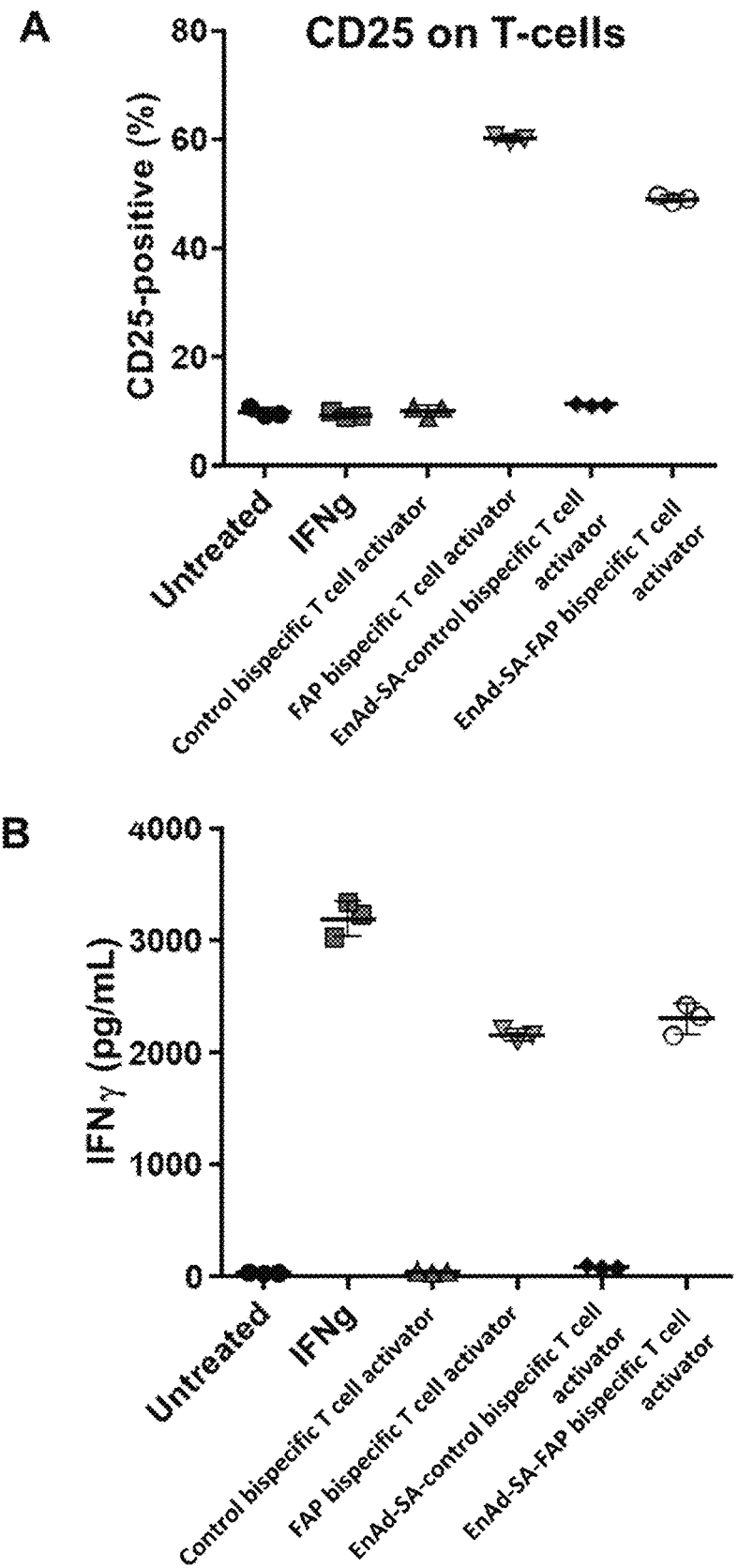
Figure 43:
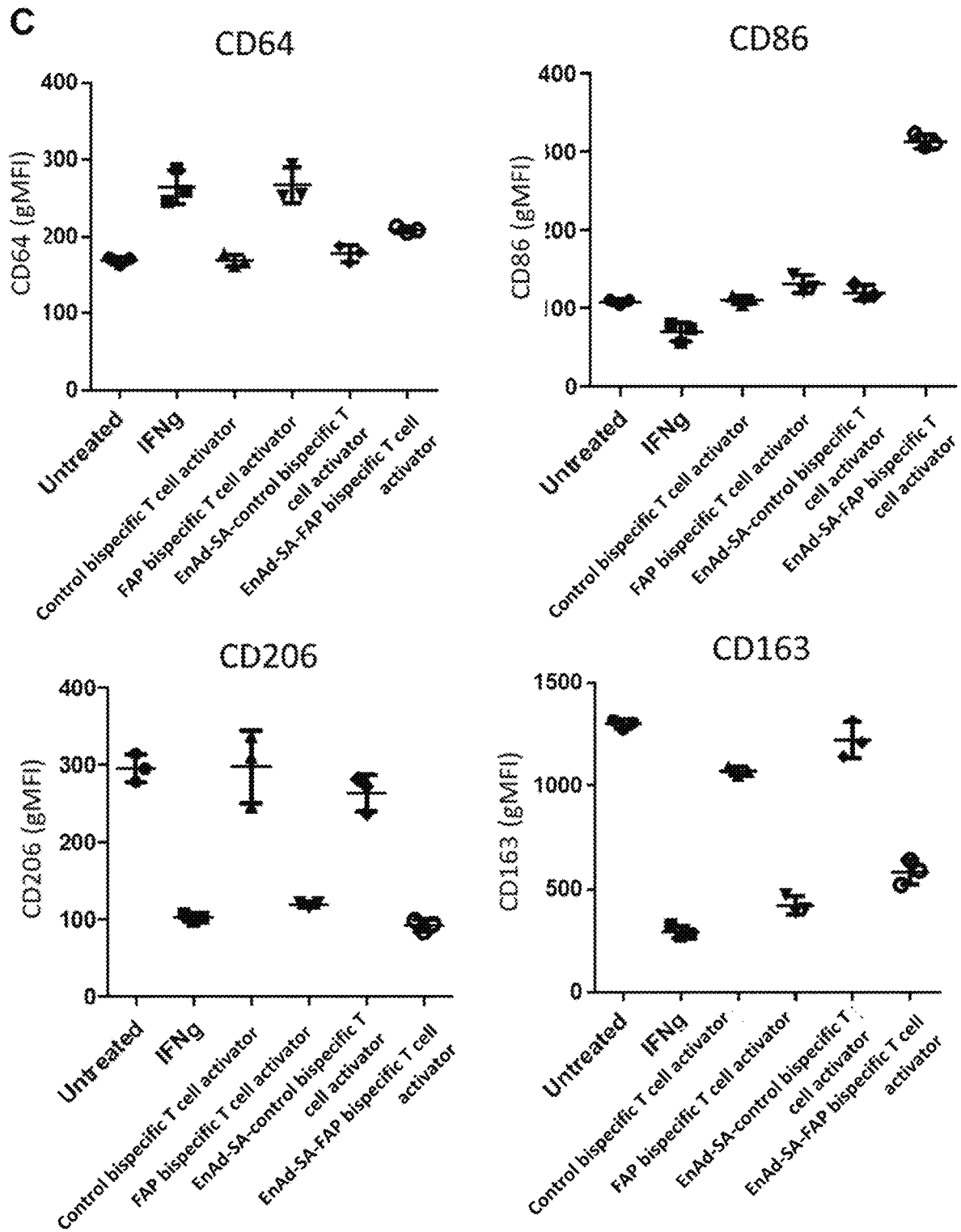

FIG. 43 FAP Bispecific T cell activator expressing EnAd polarises CD11b$^+$ macrophage in patient ascites to a more inflammatory phenotype (A) Unpurified total cells from ascites sample were incubated in 50% ascites fluid in the presence of free Bispecific T cell activator or Bispecific T cell activator expressing virus. Interferon gamma treatment was used as a positive control. After 3 days, the total cell population was harvested and the induction of activation marker CD25 on CD3$^+$ cells was measured by flow cytometry. (B) Levels of interferon gamma in culture supernatants from (A) were measured by ELISA. (C) At 3 days, the expression levels of CD68, CD86, CD206 and CD163 on CD11b+ cells from (A) were measured by flow cytometry. Representative flow cytometry spectra from triplicates is shown alongside the complete data set.

Figure 44:
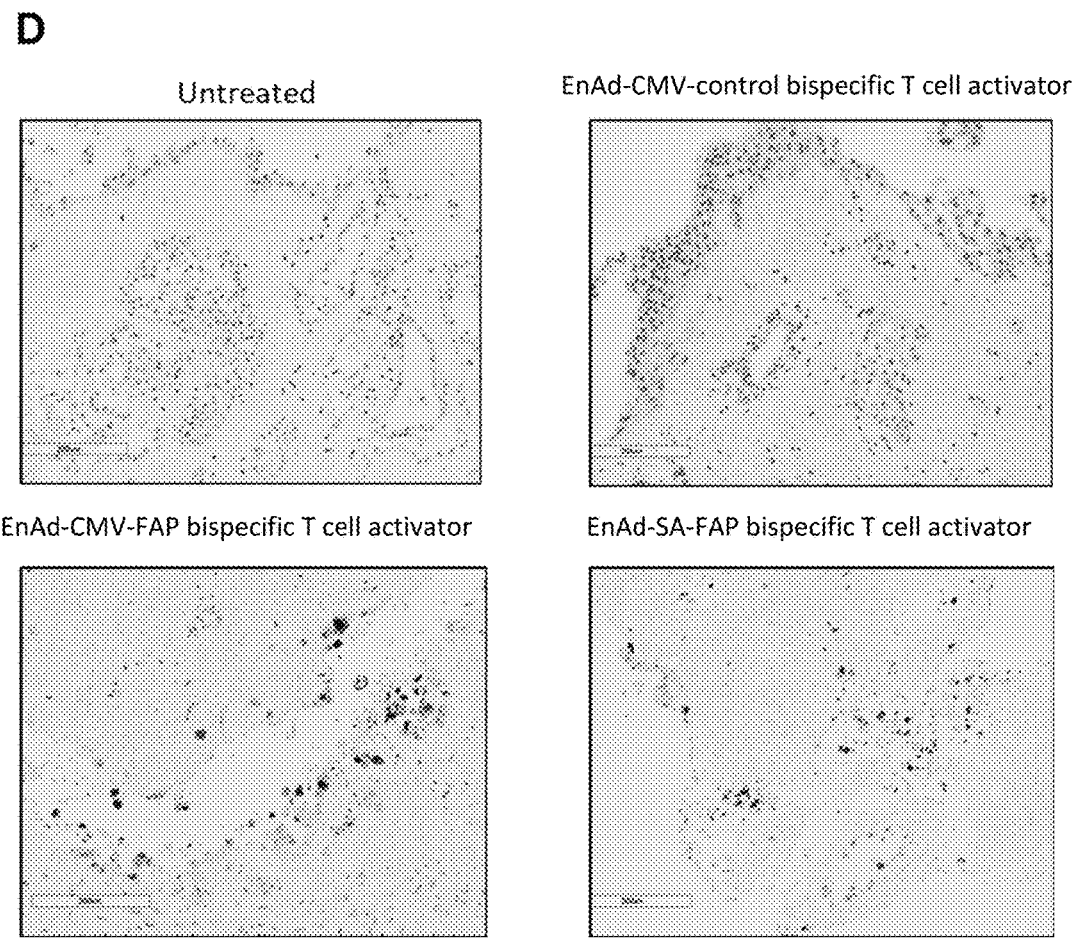
Figure 44:
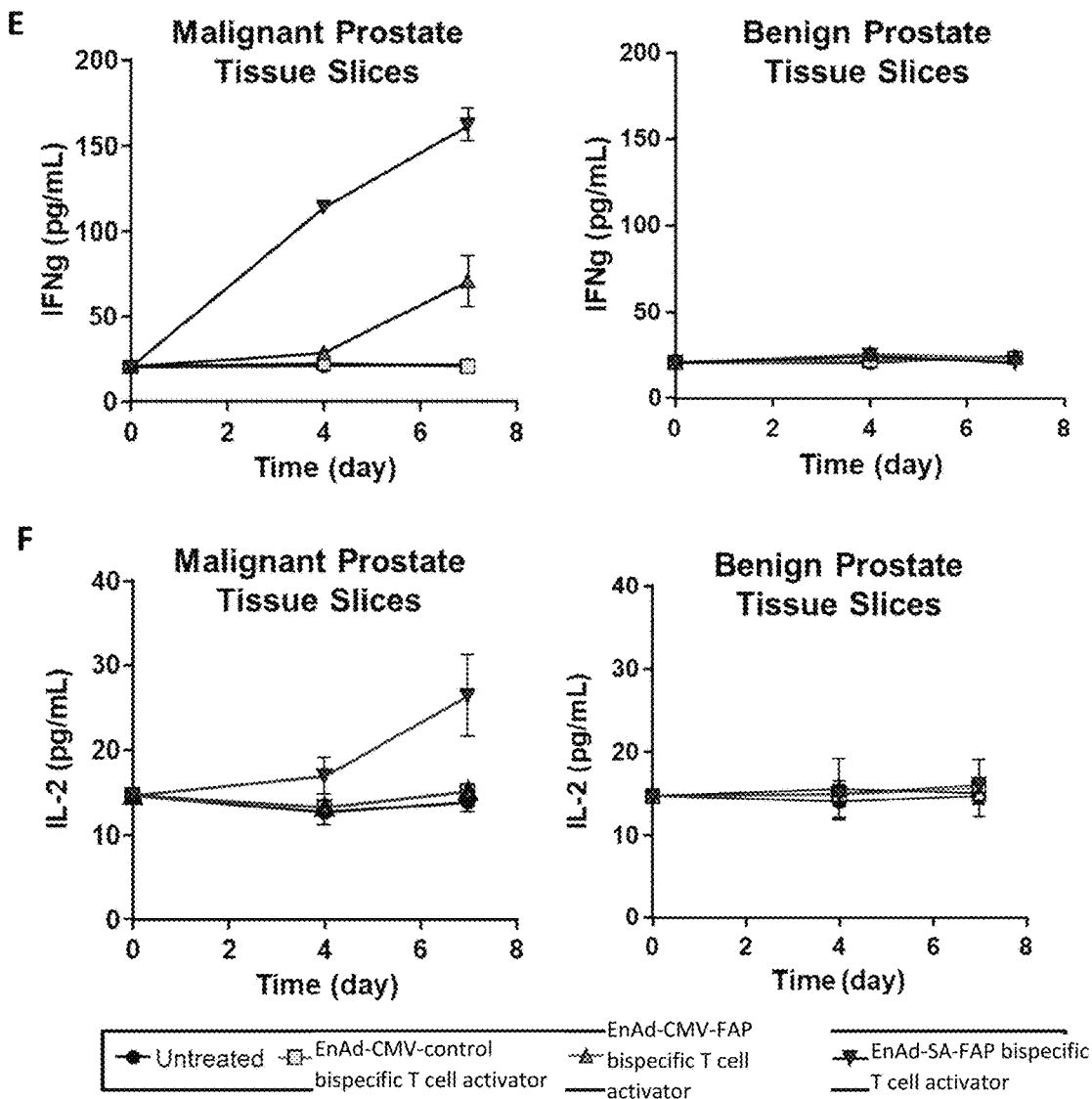

FIG. 44 Characterisation of architecture and cellular composition of solid prostate tumour (A) EpCAM staining, (B) CD8 staining, (C) FAP staining. (D) Representative immunohistochemistry images of CD25 induction within prostate tumour slices following treatment with Bispecific T cell activator expressing viruses. Tumour cores were sliced at 300 uM thickness with a Leica vibratome, cultured and infected in inserts and harvested after 7 days treatment. (E) Levels of IFNg in tissue slice culture medium measured by ELISA. Supernatants were harvested from slices cultures of malignant and benign tissue at the specified time-point (F) Levels of IL-2 in tissue culture medium of malignant and benign tissue measured by ELISA.

Figure 45:
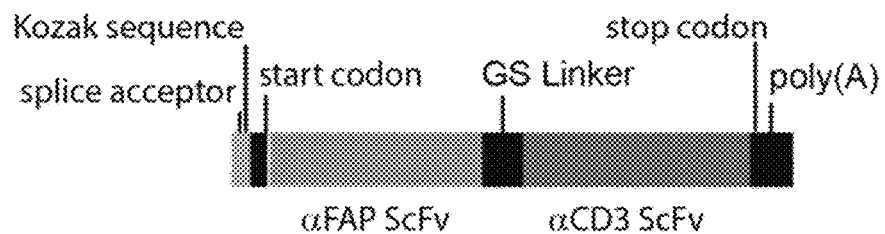

FIG. 45 shows a schematic representation of the transgene cassette.

Figure 46:
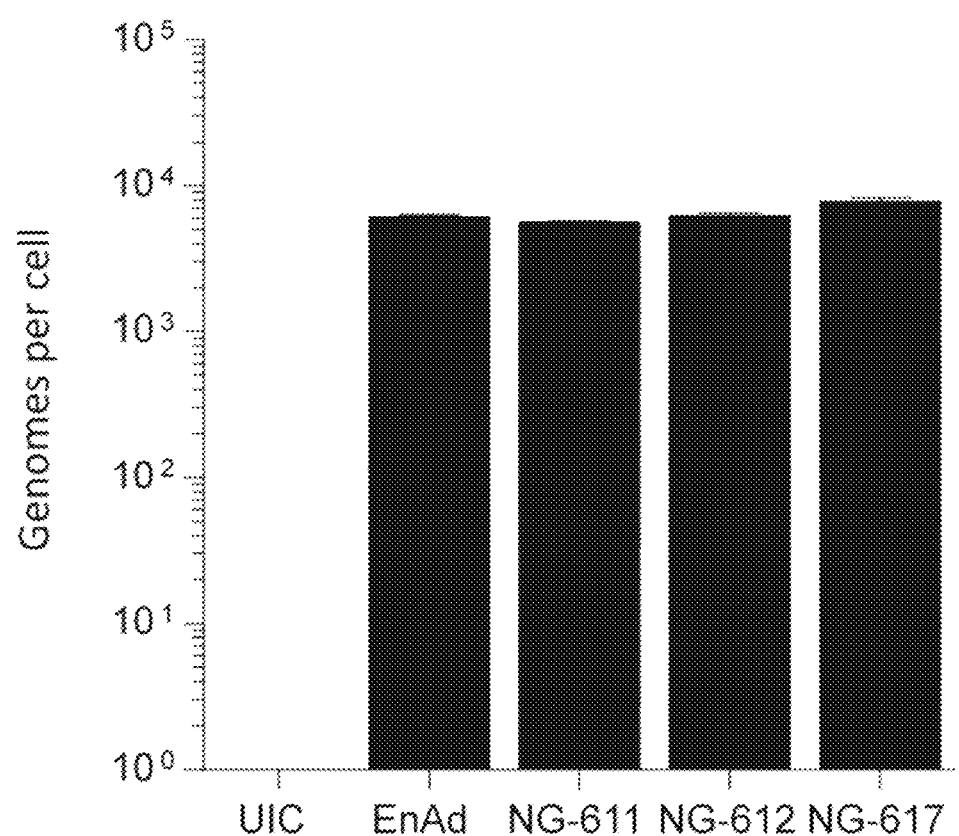

FIG. 46 shows a graph indicating the number of viral genomes detected per cell in NG-611, NG-612 and NG-617 treated tumour cells.

Figure 47:
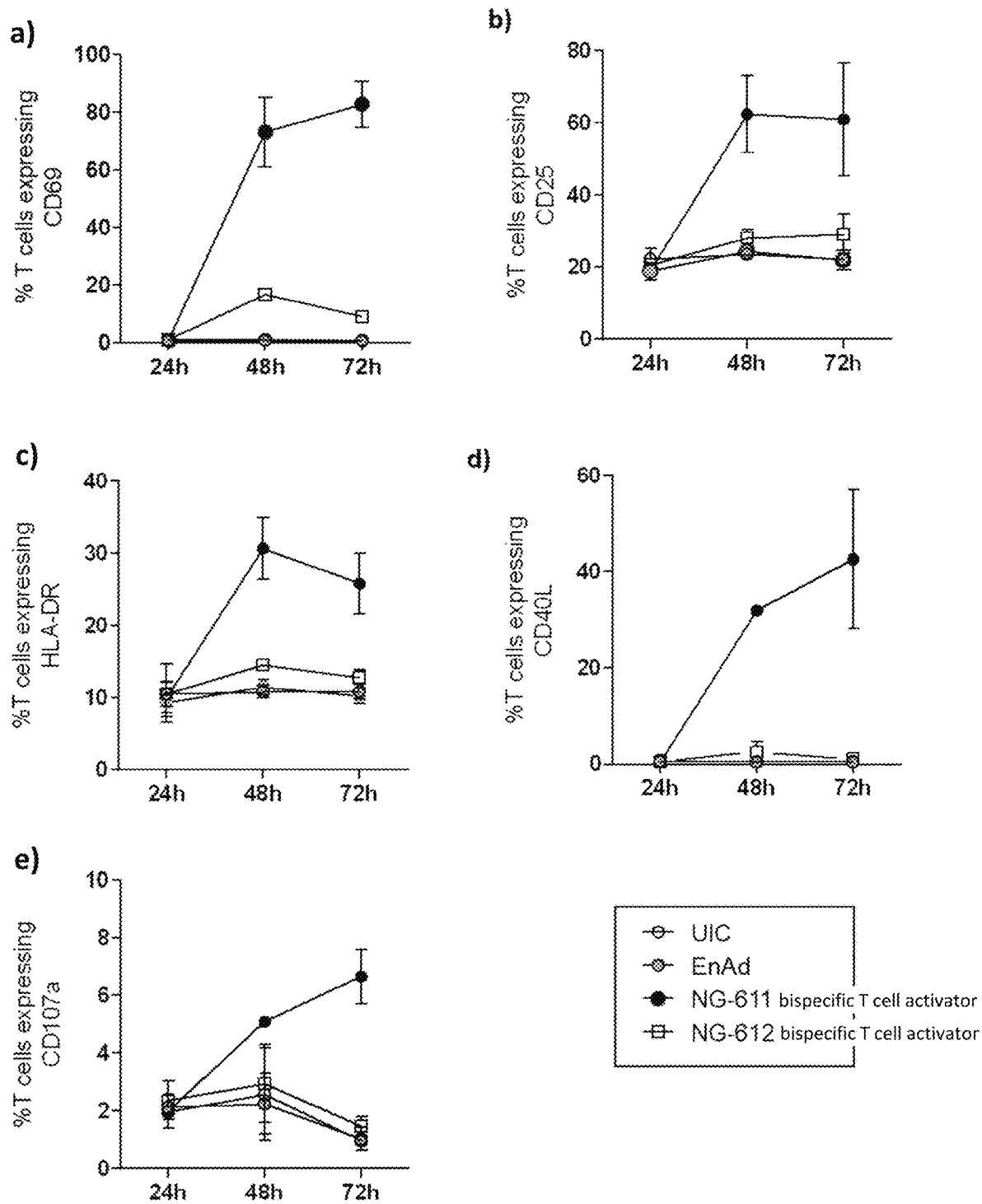

FIG. 47 shows the percentage of T cells expressing CD69 (a), CD25 (b) HLA-DR (c), CD40L (d) or cell surface CD107a (e) following co-culture with EpCam expressing SKOV cells and supernatants harvested from A549 cells at 24, 48 or 72 hrs post-treatment with NG-611 virus particles compared to NG-612, enadenotucirev or untreated control supernatants.

Figure 48:
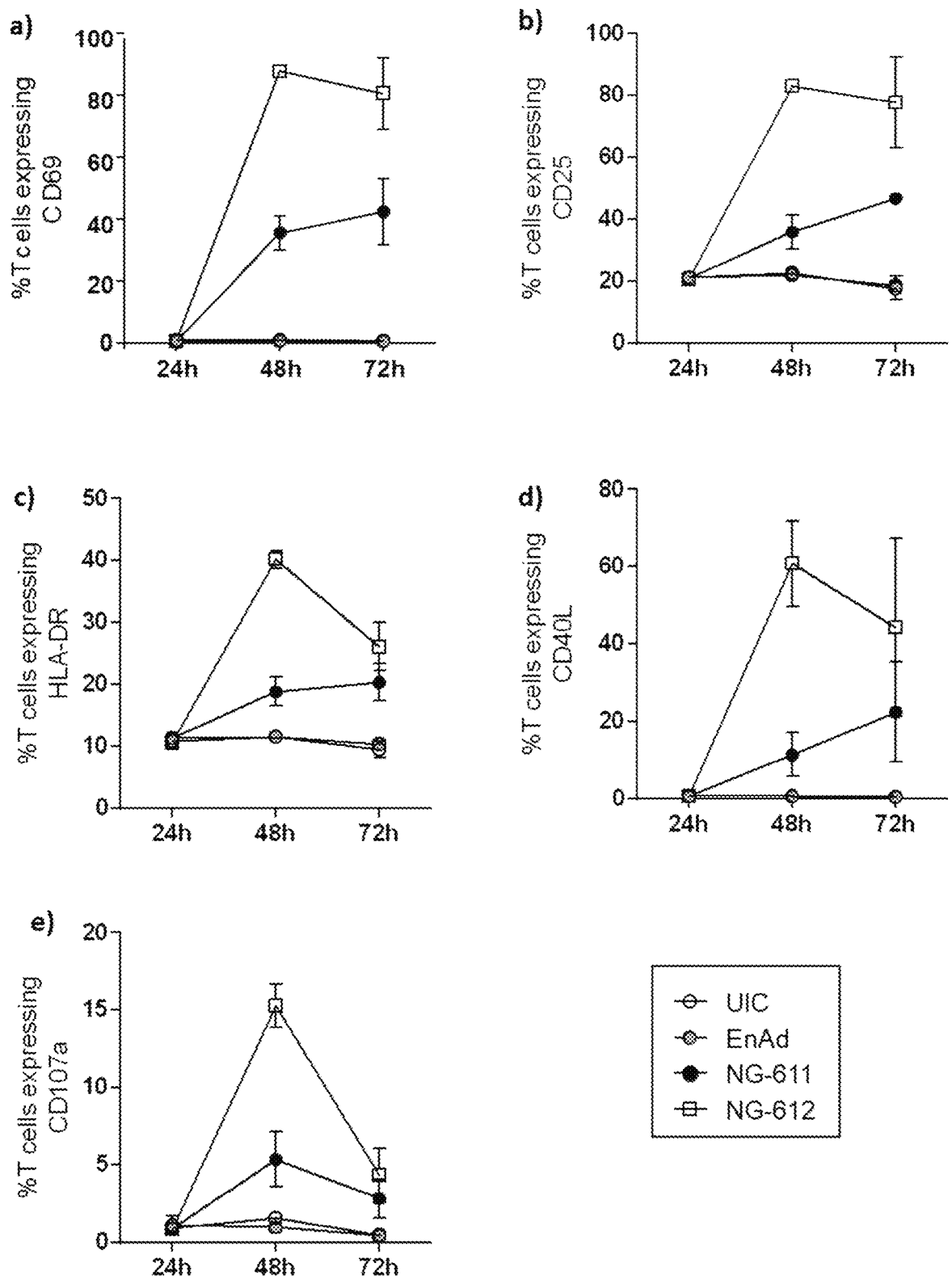

FIG. 48 shows the percentage of T cells expressing CD69 (a), CD25 (b) HLA-DR (c), CD40L (d) or cell surface CD107a (e) following co-culture with FAP expressing MRC-5 cells and supernatants harvested from A549 cells at 24, 48, or 72 hrs post-treatment with NG-612 virus particles compared to NG-611, enadenotucirev or untreated control supernatants.

Figure 49:
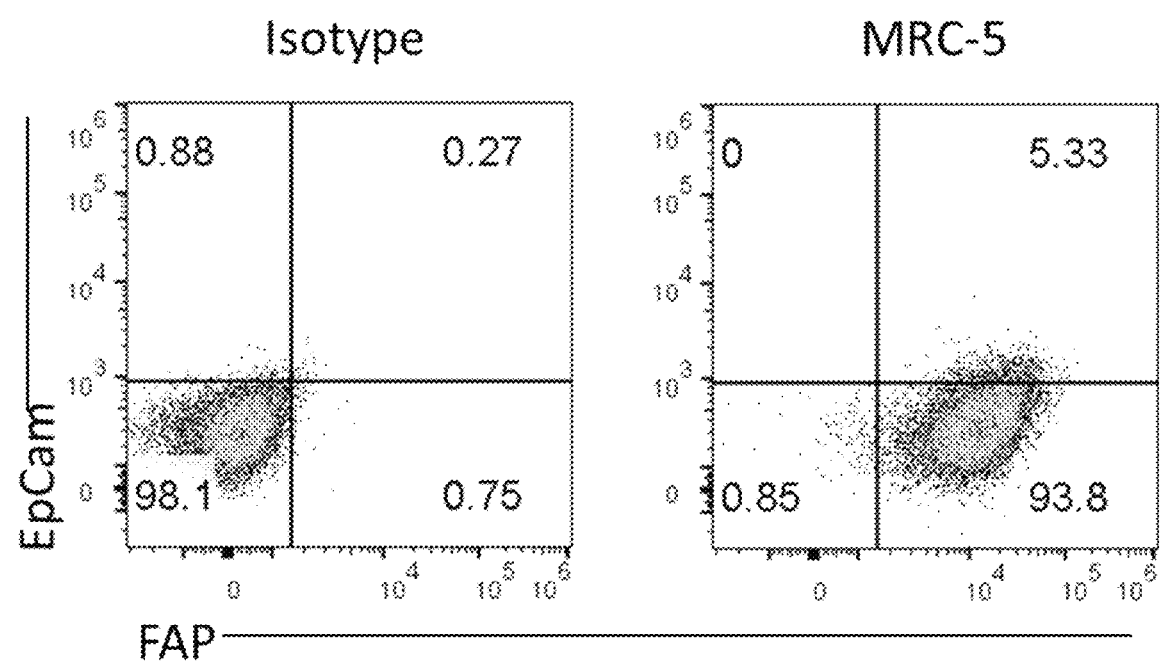

FIG. 49 shows the percentage of MRC-5 cells that express EpCAM and FAP

FIGS. 50A-50B shows IFNγ expression in the supernatants of T cell co-cultures with SKOV cells (50A) or MRC-5 cells (50B) incubated with supernatants harvested from A549 cells at 24, 48 or 72 hrs post-treatment with NG-611, NG-612 or enadenotucirev virus particles, or untreated control supernatants.

FIG. 51 shows anti-tumour efficacy and immune activation of Bispecific T cell activator expressing viruses in vivo. (a) tumour volume in mice treated with saline, enadenotucirev or NG-611. (b) Ratio of CD8 to CD4 T cells in NG-611 treated tumours compared to enadenotucirev treated or untreated controls.

Figure 52:
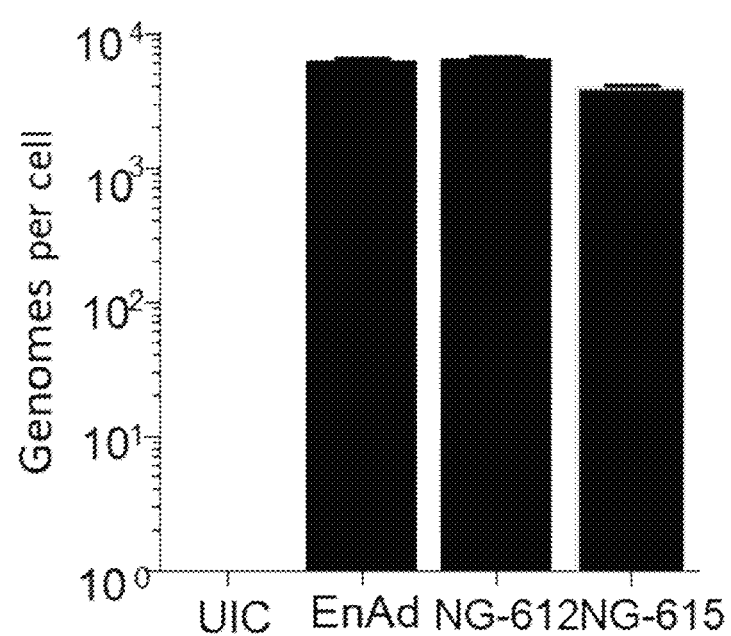
Figure 53:
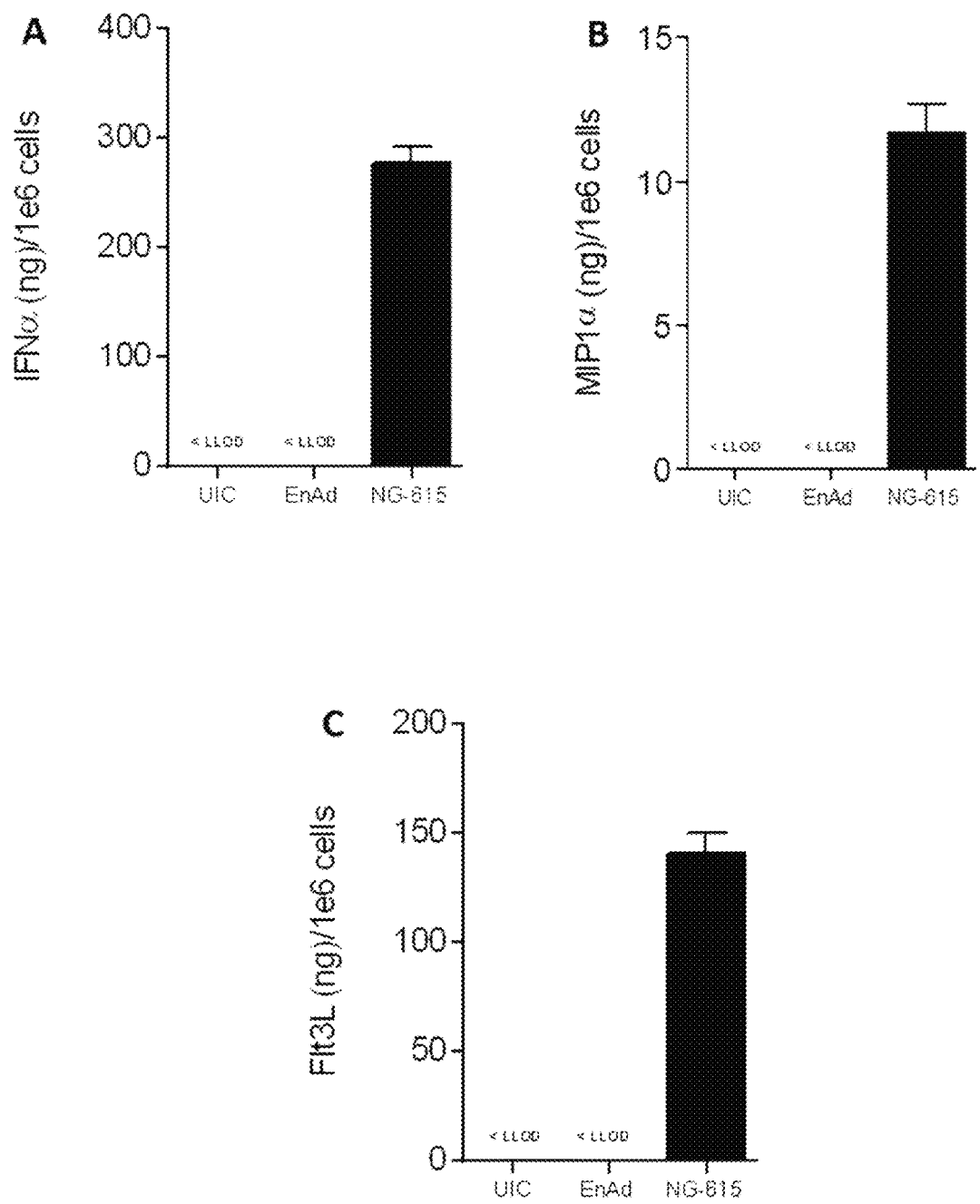

FIG. 52 shows a graph indicating the number of viral genomes detected per cell in NG-612 and NG-615 treated tumour cells FIG. 53 shows the expression of IFNα, MIP1α and Flt3 L in the cellular supernatant of NG-615 vs the supernatant of enadenotucirev and untreated control tumour cells.

Figure 54:
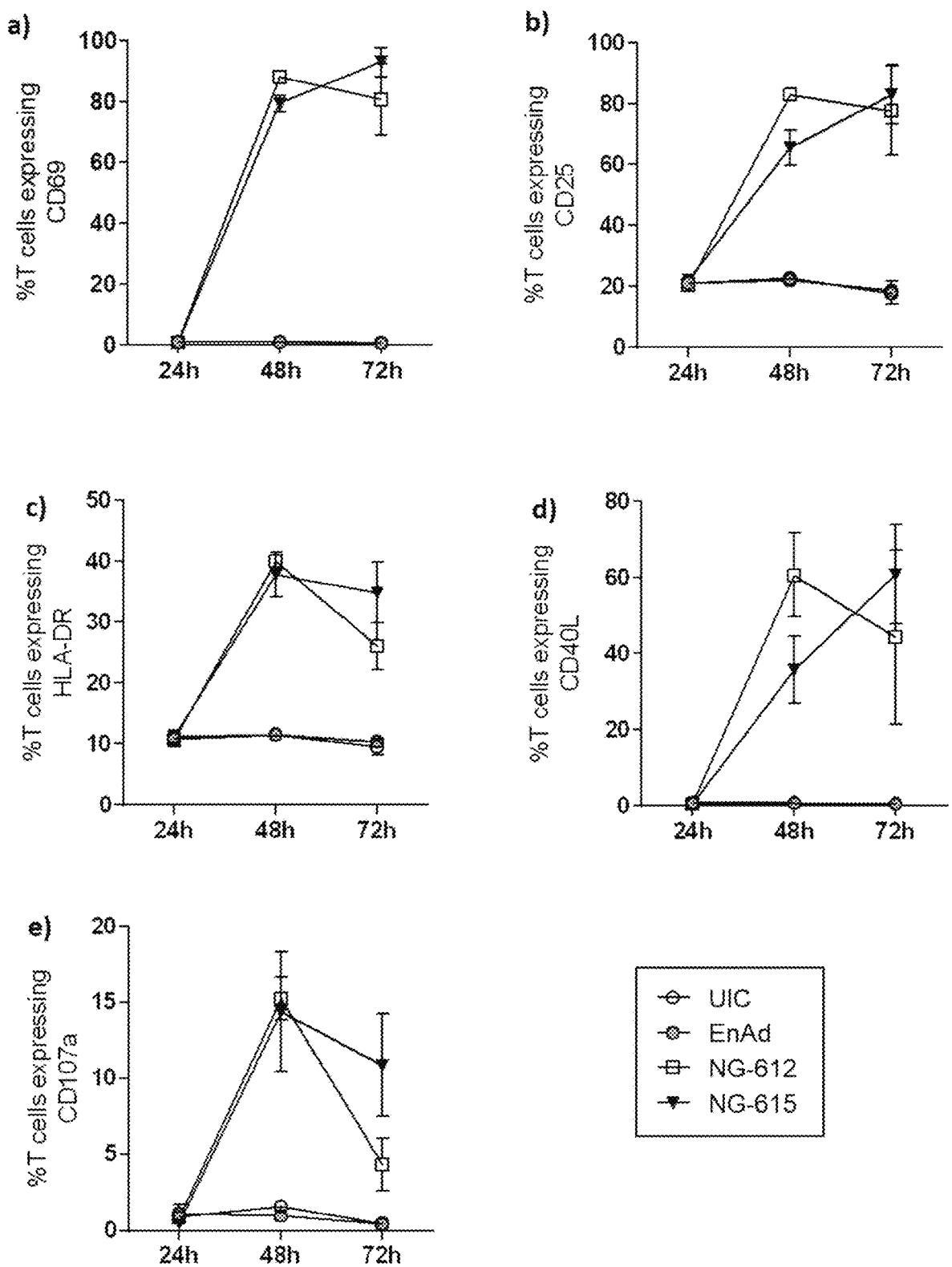

FIG. 54 shows the number of T cells expressing CD69 (a), CD25 (b) HLA-DR (c), CD40L (d) or cell surface CD107a (e)) following co-culture with FAP expressing MRC-5 cells and supernatants harvested from A549 cells at 24, 48 or 72 hrs post-treatment with NG-615 virus particles compared to NG-612, enadenotucirev or untreated control supernatants.

Figure 55:
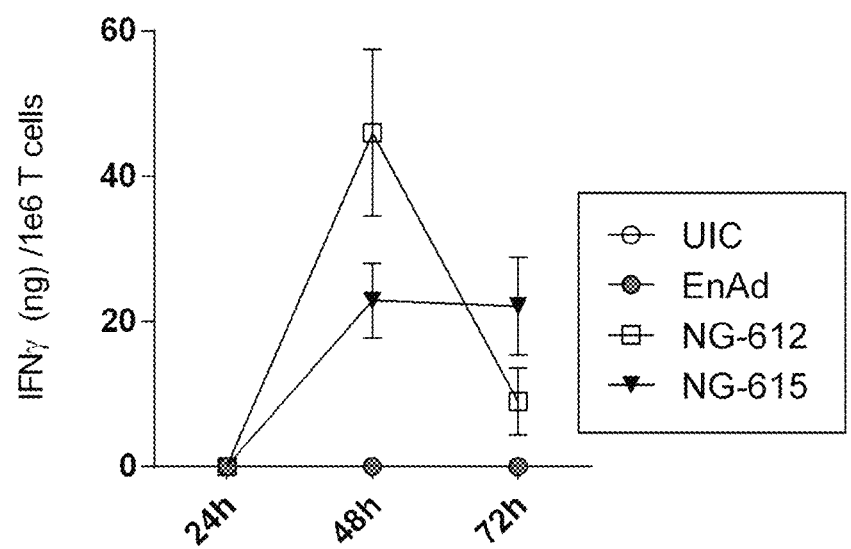

FIG. 55 shows IFNγ expression in the supernatants of T cell co-cultures with MRC-5 cells incubated with supernatants harvested from A549 cells at 24, 48 or 72 hrs post-treatment with NG-612, NG-615 or enadenotucirev virus particles, or untreated control supernatants.

SEQUENCES

SEQ ID NO: 1 Anti-FAP Bispecific T cell activator DNA coding sequence, with N-terminal signal sequence and C-terminal deca-His affinity tag SEQ ID NO: 2 Anti-FAP Bispecific T cell activator amino acid sequence, with N-terminal signal sequence and C-terminal deca-His affinity tag SEQ ID NO: 3: Control (Anti-FHA) Bispecific T cell activator DNA coding sequence, with N-terminal signal sequence and C-terminal deca-His affinity tag
SEQ ID NO: 4: Control (Anti-FHA) Bispecific T cell activator amino acid sequence with N-terminal signal sequence and C-terminal deca-His affinity tag
SEQ ID NO: 5: Anti-CD3 ScFv amino acid sequence
SEQ ID NO: 6: Anti-CD3 VH
SEQ ID NO: 7: Anti-CD3 VL
SEQ ID NO: 8: Anti-CD3 ScFv linker sequence
SEQ ID NO: 9: Anti-FAP ScFv
SEQ ID NO: 10: Anti-FAP VL domain
SEQ ID NO: 11: Anti-FAP VH domain
SEQ ID NO: 12: Anti-FAP and Anti-EpCAM linker sequence
SEQ ID NO: 13: Bispecific T cell activator leader sequence
SEQ ID NO: 14: Control Bispecific T cell activator (Anti-FHA)
SEQ ID NO: 15: Control (Anti-FHA) ScFv
SEQ ID NO: 16: Control (Anti-FHA) VL
SEQ ID NO: 17: Control (Anti-FHA) VH
SEQ ID NO: 18: Control (Anti-FHA) ScFv linker sequence
SEQ ID NO: 19: Deca-His Tag sequence
SEQ ID NO: 20: FAP Bispecific T cell activator-P2A-RFP (ITALICS=leader, BOLD=furin cleavage site, UNDERLINE=P2A sequence, lower case=RFP)
SEQ ID NO: 21: Control (Anti-FHA) Bispecific T cell activator-P2A-RFP (ITALICS=leader, BOLD=furin cleavage site, UNDERLINE=P2A sequence, lower case=RFP)
SEQ ID NO: 22: Human FAP DNA coding sequence
SEQ ID NO: 23: Human FAP amino acid sequence
SEQ ID NO: 24: CMV promoter sequence
SEQ ID NO: 25: SV40 late polyadenylation sequence
SEQ ID NO: 26: NG-605 (EnAd-CMV-FAP Bispecific T cell activator)
SEQ ID NO: 27: NG-606 (EnAd-SA-FAP Bispecific T cell activator)
SEQ ID NO: 28 EnAd genome
SEQ ID NO: 29 $B_X$ DNA sequence corresponding to and including bp 28166-28366 of the EnAd genome
SEQ ID NO: 30 $B_Y$ DNA sequence corresponding to and including bp 29345-29379 of the EnAd genome
SEQ ID NO: 31 HIS-Tag
SEQ ID NO: 32 Splice acceptor sequence.
SEQ ID NO: 33 SV40 poly Adenylation sequence
SEQ ID NO: 34 FAP Bispecific T cell activator nucleic acid sequence (OKT3)
SEQ ID NO: 35 FAP Bispecific T cell activator nucleic acid sequence (aCD3)
SEQ ID NO: 36 NG-611 Transgene cassette
SEQ ID NO: 37 NG-612 Transgene cassette
SEQ ID NO: 38 NG-613 Transgene cassette
SEQ ID NO: 39 Restriction site insert ($B_X$)
SEQ ID NO: 40 Restriction site insert ($B_Y$)
SEQ ID NO: 41 CMV promoter sequence
SEQ ID NO: 42 PGK promoter sequence
SEQ ID NO: 43 CBA promoter sequence
SEQ ID NO: 44 short splice acceptor (SSA) DNA sequence
SEQ ID NO: 45 splice acceptor (SA) DNA sequence
SEQ ID NO: 46 branched splice acceptor (bSA) DNA sequence
SEQ ID NO: 47 Kozak sequence (null sequence)
SEQ ID NO: 48 Example of start codon
SEQ ID NO: 49 Internal Ribosome Entry Sequence (IRES)
SEQ ID NO: 50 P2A peptide
SEQ ID NO: 51 F2A peptide
SEQ ID NO: 52 E2A peptide
SEQ ID NO: 53 T2A peptide
SEQ ID NO: 54 polyadenylation (polyA) sequence
SEQ ID NO: 55 Leader sequence
SEQ ID NO: 56 Leader sequence
SEQ ID NO: 57 IFNγ amino acid sequence
SEQ ID NO: 58 IFNα amino acid sequence
SEQ ID NO: 59 TNFα amino acid sequence
SEQ ID NO: 60 DNA sequence corresponding to E2B region of the EnAd genome (bp 10355-5068)
SEQ ID NO: 61: Anti-FAP Bispecific T cell activator DNA coding sequence, with N-terminal signal sequence without C-terminal deca-His affinity tag
SEQ ID NO: 62: Anti-FAP Bispecific T cell activator amino acid sequence, with N-terminal signal sequence without C-terminal deca-His affinity tag
SEQ ID NO: 63: Control (Anti-FHA) Bispecific T cell activator DNA coding sequence, with N-terminal signal sequence without C-terminal deca-His affinity tag
SEQ ID NO: 64: Control (Anti-FHA) Bispecific T cell activator amino acid sequence with N-terminal signal sequence without C-terminal deca-His affinity tag
SEQ ID NO: 65: Control Bispecific T cell activator (Anti-FHA) without C-terminal deca-His affinity tag
Q ID NO: 66: NG-605 (EnAd-CMV-FAP Bispecific T cell activator) without deca-His affinity tag
SEQ ID NO: 67: NG-606 (EnAd-SA-FAP Bispecific T cell activator) without deca-His affinity tag
SEQ ID NO: 68: FAP Bispecific T cell activator nucleic acid sequence (OKT3)
SEQ ID NO: 69: FAP Bispecific T cell activator nucleic acid sequence (aCD3)
SEQ ID NO: 70: NG-611 Transgene cassette
SEQ ID NO: 71: NG-612 Transgene cassette
SEQ ID NO: 72: NG-613 Transgene cassette
SEQ ID NO: 73: NG-614 Transgene cassette
SEQ ID NO: 74: NG-617 Transgene cassette
SEQ ID NO: 75: FAP Bispecific T cell activator amino acid sequence (OKT3)
SEQ ID NO: 76: FAP Bispecific T cell activator amino acid sequence (aCD3)
SEQ ID NO: 77: NG-611 Genome
SEQ ID NO: 78: NG-612 Genome
SEQ ID NO: 79: NG-613 Genome
SEQ ID NO: 80: NG-614 Genome
SEQ ID NO: 81: NG-617 Genome
SEQ ID NO: 82: NG-615 Genome
SEQ ID NO: 83: NG-640 Genome
SEQ ID NO: 84: NG-641 Genome
SEQ ID NO: 85: Null sequence
SEQ ID NO: 86: Flt3L nucleic acid sequence
SEQ ID NO: 87: Null sequence
SEQ ID NO: 88: MIP1α nucleic acid sequence
SEQ ID NO: 89: Flexible linker sequence
SEQ ID NO: 90: IFNα nucleic acid sequence
SEQ ID NO: 91: CXCL10 nucleic acid sequence
SEQ ID NO: 92: CXCL9 nucleic acid sequence
SEQ ID NO: 93: NG-615 Transgene cassette
SEQ ID NO: 94: NG-640 Transgene cassette
SEQ ID NO: 95: NG-641 Transgene cassette
SEQ ID NO: 96: FLT3L amino acid sequence
SEQ ID NO: 97: MIP1α amino acid sequence
SEQ ID NO: 98: IFNα amino acid sequence SEQ ID NO: 99: CXCL9 amino acid sequence
SEQ ID NO: 100: CXCL10 amino acid sequence
SEQ ID NO: 101: NG-618 Genome
SEQ ID NO: 102: NG-618 FAP Bispecific T cell activator nucleic acid sequence
SEQ ID NO: 103: NG-618 Transgene cassette
SEQ ID NO: 104 to 277 are linker sequences
SEQ ID NO: 278 NG-616 Genome
SEQ ID NO: 279 to 281 are primers

EXAMPLES

Example 1

Recombinant Bispecific T cell activators were designed and proteins produced as described in this example.

1.1 Bispecific T Cell Activator Engineering

Figure 1:
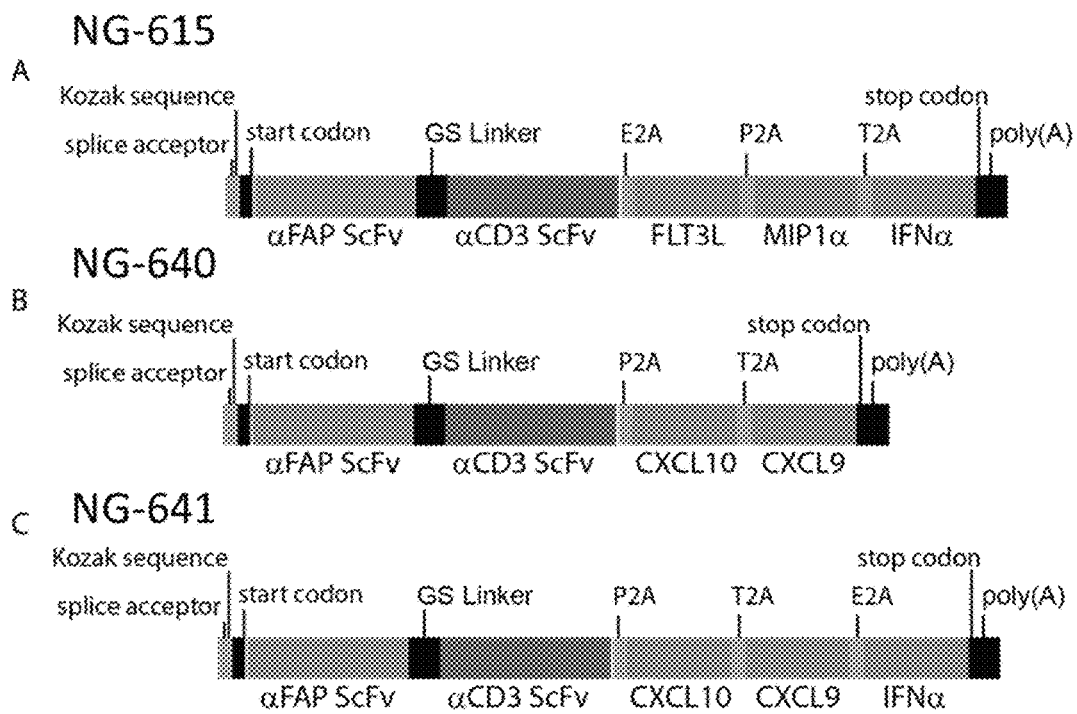
FIG. 1 Shows schematics of the NG-615, NG-640 and NG-641 transgene cassettes

Bispecific T cell activators are generated by joining two single chain antibody fragments (ScFv) of different specificities with a flexible $Gly_4Ser$ linker. ScFv's are created by the joining of $V_H$ and $V_L$ domains from parental monoclonal antibodies by a linker. Each Bispecific T cell activator was designed with an N-terminal signal sequence for mammalian secretion and a C-terminal decahistidine affinity tag for detection and purification. Bispecific T cell activators were engineered by standard DNA cloning techniques and inserted into protein expression vectors (FIG. 1).

The anti-FAP Bispecific T cell activator was created de novo using the anti-FAP ScFv from patent WO2010037835A2 and the anti-CD3 ScFv from patent WO 2005040220 (SEQ ID 63 therein), with a signal sequence and affinity tag added.

A control Bispecific T cell activator used the anti-FHA (filamentous haemagglutinin from *Bordetella pertussis*) ScFv from Hussein et al, 2007 (Hussein A H et al (2007) "Construction and characterization of single-chain variable fragment antibodies directed against the *Bordetella pertussis* surface adhesins filamentous hemagglutinin and pertactin". Infect Immunity 75, 5476-5482) and the anti-CD3 ScFv from patent WO 2005040220 (SEQ ID NO: 63 therein), with a signal sequence and affinity tag added.

1.2 Recombinant Bispecific T Cell Activator Production

Recombinant Bispecific T cell activator proteins were produced by cloning the respective sequences into the pSF-CMV vector using a CMV promoter (SEQ ID NO: 24) to drive protein expression (FIG. 1). The concentration of plasmid DNA for plasmids, pSF-CMV-FAP Bispecific T cell activator and pSF-CMV-Control Bispecific T cell activator (Table 2), were measured via NanoDrop. Empty pSF-CMV vector is included as a negative control. 54.7 µg of each was diluted with 4 mL OptiMEM. 109.2 ug PEI (linear, MW 25000, Polysciences, USA) were diluted in 4 mL OptiMEM medium and mixed with the 4 ml of diluted DNA to generate DNA-PEI complexes (DNA:PEI ratio of 1:2 (w/w)). After incubation at room temperature for 20 minutes, the complex mixture was topped up to 18 mL with OptiMEM and this transfection mixture was added to a T175 flask containing Ad293 cells at 90% confluency. After incubation of the cells with the transfection mix for 4 hrs at 37° C., 5% $CO_2$, 30 mL of cell media (DMEM high glucose with glutamine supplemented, phenol red-free) was added to the cells and the flasks was incubated 37° C., 5% $CO_2$ for 48 hours. Another flask of cells was transfected in parallel with pSF-CMV-GFP to ensure efficient transfection efficiency. In order to harvest secreted protein, the supernatant of transfected cells was collected and centrifuged at 350 g at 4° C. for 5 minutes to remove cell components (Allegra X-15R, Beckman Coulter). Supernatants were transferred to 10 k MWCO Amicon Ultra-15 Centrifugal Filter Units (Millipore). After spinning at 4750 rpm and 4° C., the volume of the retentate was adjusted with the flow through to obtain a 50-fold higher concentration. Aliquots of concentrated protein were stored at −80° C.

Table 2

"p" employed as a prefix in naming constructs indicates that the construct is a plasmid.

TABLE 2

"p" employed as a prefix in naming constructs indicates that the construct is a plasmid.

| Plasmid ID | [plasmid DNA] ng/ml |
|---|---|
| pSF-CMV-FAP Bispecific T cell activator | 6700 |
| pSF-CMV-Control Bispecific T cell activator | 5300 |
| pSF-Lenti-FAP | 659.6 |

1.3 Production of Viruses Expressing FAP-Bispecific T Cell Activators in Combination with Immunomodulatory Proteins Three viruses (NG-640, NG-641 and NG-615) were generated encoding a FAP targeting Bispecific T cell activator molecule and 2 or 3 immunomodulatory proteins (Table 1). NG-640 encodes three transgene proteins, the FAP-Bispecific T cell activator molecule and chemokines CXCL9 and CXCL10. NG-641 and NG-615 both encode four transgene proteins. NG-641 encodes the FAP-Bispecific T cell activator, chemokines CXCL9 and CXCL10 and the cytokine IFNα and NG-615 encodes the FAP-Bispecific T cell activator, the chemokine MIP1α and the cytokines FLT3 Ligand and IFNα. A virus was also generated encoding just the FAP-Bispecific T cell activator molecule (NG-617)

TABLE 1

| Virus ID | Transgene Cassette |
|---|---|
| NG-615 (SEQ ID NO: 1) | SSA[1]-FAP Bispecific T cell activator[2]-E2A[3]-Flt3L[4]-P2A[5]-MIP1α[6]-T2A[7]-IFNα[8]-PA[9] |
| NG-640 (SEQ ID NO: 2) | SSA[1]-FAP Bispecific T cell activator[2]-P2A[5]-CXCL10[10]-T2A[7]-CXCL9[11]-PA[9] |
| NG-641 (SEQ ID NO: 3) | SSA[1]-FAP Bispecific T cell activator[2]-P2A[5]-CXCL10[10]-T2A[7]-CXCL9[11]-E2A[3]-IFNα[8]-PA[9] |
| NG-617 (SEQ ID NO: 4) | SSA[1]-FAP Bispecific T cell activator[2]-PA[9] |

In each transgene cassette, the cDNA encoding the Bispecific T cell activator and other immune modulatory proteins was flanked at the 5' end with a short splice acceptor sequence (SSA, CAGG) and at the 3' end with a SV40 late poly(A) sequence (PA, SEQUENCE ID NO: 25). cDNA sequences for each transgene were separated using 2A high efficiency self-cleavable peptide sequences (P2A, T2A, E2A, SEQUENCE ID NO: 50, 53 and 52).

Virus Production

The plasmid pEnAd2.4 was used to generate the plasmids pNG-615, pNG-640 and pNG-641 by direct insertion of synthesised transgene cassettes (SEQ ID NOs: 93, 94 and 95, respectively). NG-615 contains four transgenes encoding for a FAP-targeting Bispecific T cell activator (SEQ ID NO: 102), Flt3L (SEQ ID NO. 86), MIP1α (SEQ ID NO. 88) and IFNα (SEQ ID NO. 90). NG-640 and NG-641 encode for a FAP targeting Bispecific T cell activator (SEQ ID NO. 102), CXCL9 (SEQ ID NO. 92) and CXCL10 (SEQ ID NO. 91), NG-641 also contains a fourth transgene encoding IFNα (SEQ ID NO. 90). Schematics of the transgene cassettes are shown in FIG. 1. Construction of plasmid DNA was confirmed by restriction analysis and DNA sequencing.

The plasmids, pNG-615, pNG-640 and pNG-641, were linearized by restriction digest with the enzyme AscI to produce the virus genomes. The viruses were amplified and purified according to the methods given below.

Digested DNA was purified by phenol/chloroform extraction and precipitated for 16 hrs, −20° C. in 300 μl >95% molecular biology grade ethanol and 10 μl 3M Sodium Acetate. The precipitated DNA was pelleted by centrifuging at 14000 rpm, 5 mins and was washed in 500 μl 70% ethanol, before centrifuging again, 14000 rpm, 5 mins. The clean DNA pellet was air dried, resuspended in 500 μl OptiMEM containing 15 μl lipofectamine transfection reagent and incubated for 30 mins, RT. The transfection mixture was then added drop wise to a T-25 flask containing 293 cells grown to 70% confluency. After incubation of the cells with the transfection mix for 2 hrs at 37° C., 5% $CO_2$ 4 mls of cell media (DMEM high glucose with glutamine supplemented with 2% FBS) was added to the cells and the flasks was incubated 37° C., 5% $CO_2$.

The transfected 293 cells were monitored every 24 hrs and were supplemented with additional media every 48-72 hrs. The production of virus was monitored by observation of a significant cytopathic effect (CPE) in the cell monolayer. Once extensive CPE was observed the virus was harvested from 293 cells by three freeze-thaw cycles. The harvested viruses were used to re-infect 293 cells in order to amplify the virus stocks. Viable virus production during amplification was confirmed by observation of significant CPE in the cell monolayer. Once CPE was observed the virus was harvested from 293 cells by three freeze-thaw cycles. The amplified stocks of viruses were used for further amplification before the viruses were purified by double caesium chloride banding to produce purified virus stocks.

Example 2: Analysis of Virus Replication and Oncolytic Activity

Virus Replication

Lung (A549), breast (MDA-MB-453) or bladder (RT4) carcinoma cell lines inoculated for 72 hrs with 1 ppc NG-615, NG-640, NG-641, NG-617, enadenotucirev (EnAd) or left uninfected were used for quantification of viral DNA by qPCR. Cell supernatants were collected and clarified by centrifuging for 5 mins, 1200 rpm. 50 μL of supernatant was used for DNA analysis.

Figure 2A:
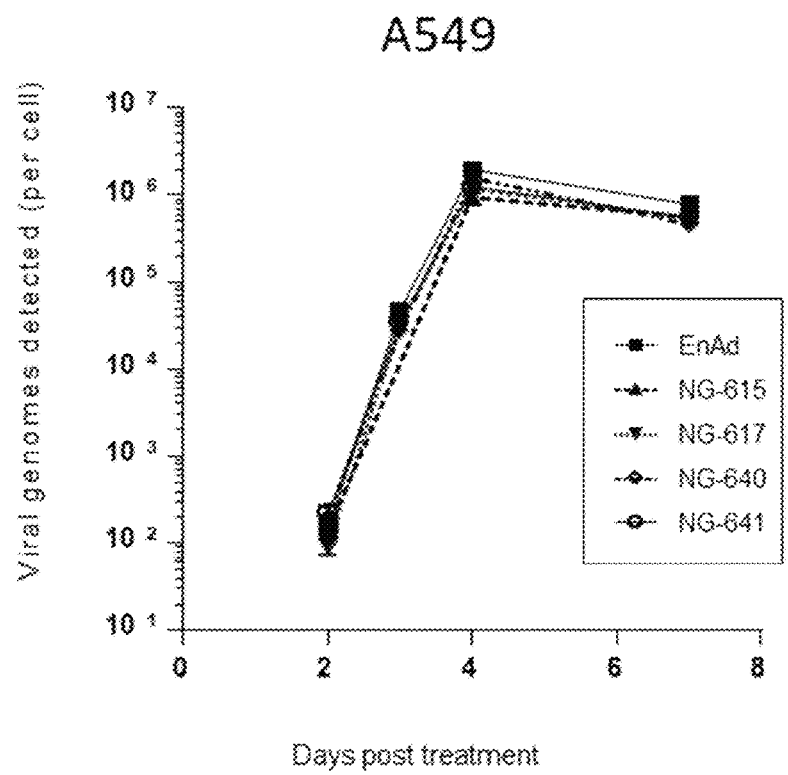

DNA was extracted from the supernatant sample using the Qiagen DNeasy kit, according to the manufacturer's protocol. A standard curve using EnAd virus particles (2.5e10-2.5e5vp) was also prepared and extracted using the DNeasy kit. Each extracted sample or standard was analysed by qPCR using a virus gene specific primer-probe set to the early gene E3. Quantification of the number of detected virus genomes per cell demonstrated viral replication in A549, MDA-MB-453 and RT4 for all viruses tested (NG-617, NG-615, NG-640 and NG-641) (FIGS. 2A-2C). Viral replication was similar for all viruses and was equivalent to that of the parental EnAd virus. No virus genomes could be detected in uninfected cells.

Oncolytic Activity

Lung (A549) carcinoma cells inoculated with 100 ppc NG-615, NG-640, NG-641, NG-617, EnAd or left uninfected were monitored using a xCELLigence Real Time Cell Analyzer (RTCA). Cell proliferation was monitored every 60 minutes for up to 96 hours. Oncolysis of the cells was assessed by calculating the Killing Time 50 (KT50) which is the time point when 50% lysis is reached (FIGS. 3A-3B). These data showed an equivalent KT50 across all viruses tested including the parental EnAd virus.

No oncolytic effect was observed on untreated cells.

Collectively these data indicate that inclusion of a Bispecific T cell activator and either two or three immunomodulatory transgenes does not significantly impact the replicative or oncolytic activity of the EnAd virus.

Example 3: Analysis of Virus Mediated Transgene Expression Recombinant Bispecific T Cell Activator Detection To detect the Bispecific T cell activator, the C-terminal decahistidine affinity tag can be probed with an anti-His antibody using the technique of western blotting. Protein samples were adjusted with lysis buffer to a final volume of 15 μL including 2.5 μL 6× Laemmli SDS Sample Buffer which contains β-mercaptoethanol and SDS. Samples were incubated for 5 minutes at 95° C. to denature proteins and loaded onto 15-well 10% precast polyacrylamide gels (Mini-PROTEAN TGX Precast Gels, BioRad, UK). Gels were run at 180 V for 45 minutes in 1× running buffer within a Mini-PROTEAN Tetra System (BioRad, UK). Proteins from the SDS gels were transferred onto nitrocellulose membranes by wet electroblotting at 300 mA and 4° C. for 90 minutes in 1× transfer buffer within a Mini Trans-Blot Cell (BioRad, UK). Transfer was performed in presence of an ice pack to limit heat. The nitrocellulose membrane was then blocked with 5% milk in PBS-T on a shaker for 1 hour at room temperature, and probed with anti-His (C-term) antibody (mouse α-6×His, clone 3D5, Invitrogen, UK, #46-0693), diluted 1:5000 in PBS/5% milk. After incubation on a shaker overnight at 4° C., the membrane was washed and probed with HRP-labelled polyclonal secondary α-mouse-immunoglobulin-antibody (1:10.000 in PBS/5% milk, Dako, #P0161) for 1 hour at room temperature. For visualization, SuperSignal West Dura Extended Duration Substrate (Thermo Fisher Scientific, UK) was applied, following manufacturer's instructions and exposed to X-ray film and developed in an automatic film processor. The results demonstrated the expression and secretion of Bispecific T cell activator protein from Ad293 cells transfected with the Bispecific T cell activator expression plasmids, but not the parental vector.

Recombinant Bispecific T Cell Activator Quantification

To measure the quantity of recombinant Bispecific T cell activator protein, the technique of dot blot was used to compare the Bispecific T cell activator signal to a His-tagged (C-term 10His) protein standard (10× His-tagged human Cathepsin D, Biolegend, #556704). Two-fold serial dilutions of Bispecific T cell activator samples and protein standard were prepared, and 1.5 uL of each directly applied to a nitrocellulose membrane and air-dried for 20 minutes. The blocking and staining protocol described above for western blotting was then performed. The molar concentration of the protein standard was adjusted to represent a Bispecific T cell activator concentration of 250 µg/mL. The results (FIG. 13, panel A) demonstrated the expression and secretion of Bispecific T cell activator protein from Ad293 cells transfected with the Bispecific T cell activator expression plasmids.

FAP Binding ELISA

The FAP-binding activity of the FAP Bispecific T cell activator and control (anti-FHA) Bispecific T cell activator (SEQ ID NOs: 2 and 4) secreted from cells transfected with pSF-CMV-FAP Bispecific T cell activator or pSF-CMV-Control Bispecific T cell activator was assessed by enzyme-linked immunosorbent assay (ELISA). Empty pSF-CMV vector supernatants were included as a negative control. ELISA plates (Nunc Immuno MaxiSorp 96 well microplate) were prepared by coating overnight at 4° C. with human FAP/seprase protein (100 ng/well, Sino Biological Inc, 10464-H07H-10) in PBS buffer. Plates were washed between all subsequent binding steps with PBS 0.05% Tween 20. The plates were blocked for 1 hour at room temperature with 5% BSA in PBS 0.05% Tween 20. Aliquots of Bispecific T cell activator protein, or protein harvested from empty pSF-CMV vector-transfected wells, were diluted 10-fold into PBS/5% BSA/0.05% Tween 20. All samples were added to the FAP coated plates and incubated for 2 hr at room temperature. The detection antibody, anti-His (C-term) antibody (mouse anti-6×His, clone 3D5, Invitrogen, UK, #46-0693), was diluted 1:1000 and applied for 1 hour at room temperature. HRP conjugated anti-mouse-Fc (1:1000 in PBS/5% milk, Dako) was then applied for 1 hr at room temperature before HRP detection was performed with HRP substrate solution 3.3.5.5'-teramethy-lethylenediamine (TMB, Thermo-Fisher). Stop solution was used for terminating the reaction and the developed colour was measured at 450 nm on a plate reader. Absorbance at 450 nm was plotted for FAP Bispecific T cell activator, control Bispecific T cell activator and empty vector supernatants, demonstrating specific binding of the FAP Bispecific T cell activator to FAP protein. The results (FIG. 13, panel B) show the specific binding of the FAP Bispecific T cell activator and not control Bispecific T cell activator to recombinant FAP protein.

Transgene Expression Assessed by ELISA

Expression of the chemokine or cytokine transgenes, IFNα, MIP1α, FLT3L, CXCL10 and CXCL9 were assessed using ELISAs. A549 and RT4 carcinoma cell lines were inoculated with 1 ppc NG-615, NG-640, NG-641, NG-617, EnAd or left uninfected for up to 7 days. At 4 days and 7 days post inoculation cellular supernatants were clarified and assessed for transgene expression by ELISA.

IFNα ELISA was carried out using the Verikine Human IFN alpha Kit (Pbl assay science), MIP1α ELISA was carried out using the Human CCL3 Quantikine ELISA kit (R & D systems), Flt3L ELISA was carried out using the Flt3L human ELISA kit (Abcam), CXCL9 ELISA was carried out using the CXCL9 human ELISA kit (Abcam) and CXCL10 ELISA was carried out using the CXCL10 human ELISA kit (Abcam). All assays were carried out according to the manufacturers' protocol.

The concentrations of secreted IFNα, MIPα, FLT3L, CXCL9 and CXCL10 were determined by interpolating from the standard curves. IFNα, MIP1α and Flt3L expression could be detected in the cellular supernatant of NG-615 treated cells, IFNα, CXCL9 and CXCL10 could be detected in supernatants of NG-641 treated cells and CXCL9 and CXCL10 could be detected in the supernatants of NG-640 treated cells (FIGS. 4 and 5). No chemokine or cytokine transgene expression was detected in EnAd treated or untreated control cells.

Functional Transgene Expression Assessed by Cell-Based Reporter Assay

The expression of functional FAP-Bispecific T cell activator and IFNα transgenes were assessed in assays using a Jurkat-Dual reporter cell line (Invivogen). This is a human immortalized T lymphocyte cell line (Jurkat) transformed by the stable integration of two inducible reporter constructs. One of the inducible reporter constructs enables IFN-α activation of the interferon regulatory factor (IRF) pathway to be studied through the secretion and activity of secreted embryonic alkaline phosphatase (SEAP, while the second is an NF-kB responsive secreted luciferase reporter that is active by signalling through the T-cell receptor. Activity of SEAP is proportional to the level of IFN-α present in the supernatant and can be measured by detecting the SEAP induced degradation of the substrate Quanti-Blue™. The expression of functional MIP1α was assessed using a CCR5 reporter cell line (CHO-K1 CCR5 β-arrestin, Invivogen). A549 carcinoma cell lines were inoculated with 1 ppc NG-615, NG-640, NG-641, NG-617, EnAd or left uninfected. At 2, 3, or 4 days post-inoculation cellular supernatants were collected and clarified for analysis.

To assess IFNα function 20 µL of each supernatant, diluted 1:10, 1:50 or 1:250 in culture media, was added to Jurkat Dual cells (2×10⁵ cells/well) and incubated for 16-20 hours. The supernatants were then harvested from the plates and treated with 200 µL Quanti-Blue™ reagent for 1 hour. The plates were analysed using a microplate reader measuring absorbance (Abs) at 640 nm. Responses demonstrating the presence of functional IFNα could be detected in supernatants from NG-615 and NG-641 treated carcinoma cells but not NG-640, NG-617, EnAd treated or uninfected controls (FIG. 6A). The level of functional IFNα detected was at similar levels in NG-615 and NG-641 treated supernatants.

To assess MIP1α function CCR5 reporter cells were seeded (5×10³ cells/well) and incubated for 20-24 hours. 5 µL of supernatant from the treated tumour cells was then added to each well and incubated for 90 minutes. Luciferase reporter activity was then detected using a detection solution and quantification on a luminescence plate reader. Responses demonstrating the presence of functional MIP1α were detected in supernatants from NG-615 treated carcinoma cells and supernatants from cells treated with a positive control virus known to express MIP1α, NG-347 (FIG. 6B).

To assess FAP-Bispecific T cell activator function MRC-5 lung fibroblast cells (which express FAP on their cell membrane) were seeded (2×10⁴ cells/well) and incubated for 4 hours to allow cells to adhere to the plates. Jurkat-Dual cells (2×10⁵ cells/well) were then added to the wells along with 20 µL of supernatant from the treated tumour cells. The plates were incubated for 16-20 hours. Supernatants were then harvested and treated with 50 µL Quanti-Luc reagent before immediately reading the plates on a plate reader to detect luciferase activity. Responses demonstrating the presence of functional FAP-Bispecific T cell activator were detected in the supernatants of NG-617, NG-615, NG-640 and NG-641 treated carcinoma cells but not EnAd treated or untreated control supernatants (FIG. 7). Surprisingly, given the similar levels of IFNα produced by NG-615 and NG-641, supernatants from NG-615 treated cells had significantly lower levels of functional FAP-Bispecific T cell activator expression when compared to all other Bispecific T cell activator expressing viruses tested, including the other virus containing 4 transgenes, NG-641.

Example 2

The functional activities of recombinant Bispecific T cell activator proteins were assessed in a number of different assays prior to constructing Bispecific T cell activator transgene-bearing EnAd viruses.

Isolation of Human Peripheral Blood Mononuclear Cells (PBMCs)

Human PBMCs were isolated by density gradient centrifugation either from fresh human blood samples of healthy donors or from whole blood leukocyte cones, obtained from the NHS Blood and Transplant UK in Oxford. In either case, the samples were diluted 1:2 with PBS and 25 mL of this mixture was layered onto 13 mL Ficoll (1.079 g/mL, Ficoll-Paque Plus, GE Healthcare) in a 50 mL Falcon tube. Samples were centrifuged (Allegra X-15R, Beckman Coulter) at 1600 rpm for 30 minutes at 22° C. with the lowest deceleration setting to preserve phase separation. After centrifugation, 4 layers could be observed which included a plasma layer at the top, followed by an interface containing PBMCs, a Ficoll layer and a layer of red blood cells and granulocytes at the bottom. The PBMCs were collected using a Pasteur pipette and washed twice with PBS (1200 rpm for 10 minutes at room temperature) and resuspended in RPMI medium supplemented with 10% FBS.

Isolation of CD3-Positive T-Cells

CD3-positive (CD3+) T-cells were extracted from PBMCs by depletion of non-CD3 cells using a Pan T Cell Isolation Kit (Miltenyi Biotec, #130-096-535), according to the manufacturer's protocol.

rated, with aliquots of fluid frozen at −20° C. for storage and future analysis. The cellular fraction was treated with red blood cell lysis buffer (Roche, #11814389001) to remove red blood cells, following the manufacturer's instructions. Cell types present in each sample was determined by staining for EpCAM, EGFR, FAP, CD45, CD11b, CD56, CD3, CD4, CD8, PD1 and CTLA4 and analysed by flow cytometry. Cells were then used fresh for ex vivo T-cell activation and target cell lysis experiments. In some cases, the cells were passaged in DMEM supplemented with 10% FBS for use in later experiments.

Cell Line Maintenance

All cell lines were maintained in DMEM (Sigma-Aldrich, UK) or RPMI medium (Sigma-Aldrich, UK) as specified in Table 3, supplemented with 10% (v/v) foetal bovine serum (FBS, Gibco™) and 1% (v/v) Penicillin/Streptomycin (10 mg/mL, Sigma-Aldrich, UK), in a humidified incubator (MCO-17AIC, Sanyo) at 37° C. and 5% $CO_2$, unless otherwise specified. Cells were split every 2 to 3 days before reaching confluency by enzymatic dissociation with Trypsin/EDTA (0.05% trypsin 0.02% EDTA, Sigma-Aldrich, UK). In this process, culture medium was aspirated and cells were washed with 15 ml of PBS and subsequently cells were treated with 2 mL of Trypsin/EDTA for 2-10 minutes at 37° C. Trypsin was neutralized with 10 mL of DMEM containing 10% FBS and a portion of the cells was transferred into new flasks containing fresh medium. For routine cell culture, media was supplemented with 10% FBS, for infections and virus plasmid transfections with 2% FBS and for recombinant Bispecific T cell activator plasmid transfections with no FBS supplement.

TABLE 3

| Cell line | Origin of cells | Culturing Media | Source |
| --- | --- | --- | --- |
| Ascites-derived cell lines | Human primary ascites | DMEM | NHS Blood & Transplant UK |
| BTC100 | Human primary lung cancer-associated fibroblasts (CAF) | DMEM | University of Oxford |
| CHO-K1 | Chinese hamster ovary, adherent | RPMI | ATCC |
| CHO-K1 stable cell lines | Chinese hamster ovary, adherent | RPMI | — |
| DLD1 | Human colorectal adenocarcinoma | RPMI | ATCC |
| HEK 293A | Human embryonic kidney, adherent | DMEM | ATCC |
| HEK 293A stable cell lines | Human embryonic kidney, adherent | DMEM | — |
| HEK 293T | Human embryonic kidney, adherent | DMEM | ATCC |
| MCF-7 | Human, mammary gland, breast, adherent | DMEM | ATCC |
| Normal human dermal fibroblasts (NHDF) | Normal adult human primary dermal fibroblasts | DMEM | ATCC |
| SKOV3 | Human ovarian adenocarcinoma | DMEM | ATCC |

Processing Primary Ascites Samples

Primary human ascites samples were received from the oncology ward of the Churchill Hospital (Oxford University Hospitals) from patients with multiple indications, including but not limited to ovarian, pancreatic, breast and gastric cancer. Upon receipt, cellular and fluid fractions were sepa- Statistics In cases where two conditions were being compared, statistical analyses were performed using a t-test. In all other cases, statistical analyses were performed by using a One-way ANOVA.

Characterisation of Human T-Cell Activation by Recombinant FAP Bispecific T Cell Activator The ability of the FAP Bispecific T cell activator to induce T-cell activation in the presence or absence of normal human dermal fibroblast (NHDF) cells was compared. Human CD3$^+$ T-cells (70,000 cells per well in 96-well U-bottom plates) were co-cultured alone or with NHDF cells (10:1 T:NHDF) in the presence of media alone or 300 ng/mL FAP or control Bispecific T cell activator. Cells were co-cultured for 24 hours at 37° C. and subsequently harvested with enzyme-free cell dissociation buffer (Thermo, #13151014). The expression levels of CD69 (FIG. 14A) and CD25 (FIG. 14B) on CD45$^+$ T-cells were then analysed by antibody staining and flow cytometry and represented as geometric mean fluorescence (gMFl) values. Plate-immobilised anti-CD3 antibody (7.5 µg/mL) was used as positive control for T cell activation. The FAP Bispecific T cell activator selectively induced the expression of activation markers CD69 and CD25 on T-cells, indicating that it was able to activate T cells.

In a second similar experiment, T-cells were assessed by intracellular cytokine staining 6 hr after co-culture with NHDF cells (200,000 CD3$^+$ cells plus 40,000 NHDF in wells of a 96-well plate) and 300 ng/mL FAP or control Bispecific T cell activator. CD45$^+$ T-cells were intracellularly stained for IFNγ expression with Brefeldin A added into the culture medium 5 hours before harvest. As a positive control, T-cells were stimulated with soluble PMA (10 ng/mL) and ionomycin (1 µg/mL). The results shown in FIG. 14C indicate that the FAP Bispecific T cell activator in the presence of NHDF resulted in a significantly higher number of IFNγ expressing T-cells compared to the control Bispecific T cell activator.

Example 4

To further evaluate the functionality of the IFNα produced from the transgene in NG-641, Jurkat-Dual™ cells were treated with supernatants from A549 tumor cells either uninfected or infected with 10 particles per cell (ppc) of enadenotucirev (EnAd) or NG-641 for 3 days. To demonstrate the secretion of SEAP was IFNα specific, IFNα was blocked by incubating IFNα specific antibodies with the A549 supernatants for 30 mins prior to the treatment of the Jurkat-Dual reporter cell line—an isotype control antibody was included as a negative control. The data (FIG. 8A) show that the activity of the NG-641 treated tumour cell supernatant in the Jurkat Dual reporter assay is inhibited by the anti-IFNα antibody and not the isotype control and is thus mediated by IFNα. A different reporter assay system was used to evaluate the functionality of the CXCL9 and CXL10 chemokine transgenes in NG-641. This assay used a PathHunter β-arrestin reporter cell line expressing CXCR3, the receptor for both chemokines (Eurofins). GPCR activation following CXCL9/10 binding to CXCR3 expressed by these cells leads to β-arrestin recruitment to the receptor that is measured using a gain-of-signal assay based on Enzyme Fragment Complementation (EFC) technology. PathHunter β-arrestin CXCR3 reporter cells were treated with supernatants from A549 tumor cells either uninfected or infected with 10 particles per cell (ppc) of EnAd or NG-641 for 3 days. The concentration of CXCL9/10 in the supernatant is proportional to the luminescence in the assay. To demonstrate that the GPCR activation was CXCL9/10 specific, CXCL9 and CXCL10 were blocked by incubating CXCL9/10 specific antibodies with the A549 supernatants for 30 mins prior to the treatment of the PathHunter β-arrestin cells. The data shown in FIG. 8B show increased activity of the CXCR3 reporter cells in the presence of supernatants from NG-641 treated tumour cells compared to EnAd or uninfected controls, and that this increase is blocked by the antibodies to CXCL9/10.

As an alternative measure of chemokine functionality, the ability of chemokines to down-regulate the cell surface expression of their specific receptors was used as the basis of an assay, evaluating levels of CXCR3 receptor on anti-CD3/CD28 activated human T cells. A549 tumor cells were either uninfected or infected with 1 viral particles per cell (ppc) of enadenotucirev (EnAd) or NG-641 for 7 days and supernatants collected. Activated T cells were then treated with the supernatants for 30 minutes and levels of CXCR3 measured via flow cytometry, with data plotted as mean fluorescent intensity (MFI). To demonstrate that the down-regulation of cell surface CXCR3 was CXCL9/10 specific, CXCL9 and CXCL10 were blocked by incubating CXCL9/10 specific antibodies with the A549 tumor cell supernatants for 30 mins prior to the treatment of the activated T cells. The data shown in FIG. 9 show a selective down-regulation of CXCR3 expression on both CD4 and CD8 T-cells induced by supernatants from NG-641 infected A549 tumour cells, and this effect was abolished by pre-treatment with anti-CXCL9/10 antibodies.

Example 5: Functional Activity of FAP-Bispecific T Cell Activator Expressing Viruses in Ex Vivo Human Tumor Cell Cultures Samples of freshly excised human tumours, from planned surgical excisions, provided via a biobank under full ethical approval, were initially minced with scissors and a scalpel and then single cell suspensions were generated using a GentleMACs tissue dissociator (Miltenyi Biotec). These unseparated cell preparations were found to comprise tumour cells, fibroblasts and different immune cells, including T-cells, and were used to evaluate the ability of viruses to infect the primary tumour cells, produce their encoded transgenes and activate the tumour infiltrating T-cells also present in the cultures. Cells were resuspended in culture media consisting of Ham's F-12 Nutrient Mix, GlutaMAX™ Supplement (Gibco), 1× Insulin-Transferrin-Selenium-Ethanolamine (ITS-X) (Gibco), Amphotericin B 2.5 mg/mL (Gibco™), Penicillin 100 units/mL, Streptomycin 100 mg/mL, Sodium Pyruvate and 10% FBS, and plated at ~1×10$^6$ cells/ml in either 96 well plates (0.25 ml final volume) or 24 well plates (0.5 ml final volume). They were inoculated with EnAd, NG-615, NG-617, NG-640 or NG-641 at 1000 ppc, or left untreated (UIC). As a positive T-cell activation control, some wells were also stimulated with anti-CD3 and anti-CD28 antibodies each at 2 µg/ml. Cells were cultured in duplicate wells for 72 h, then supernatants were collected and levels of different cytokines produced were measured using multi-cytokine fluorescent bead-based kits (LEGENDplex™) and a flow cytometer. Three non-small cell lung carcinoma (NSCLC) samples (T016, T017, T024), one renal cell carcinoma (RCC) and one colorectal (CRC) liver metastasis sample were tested. In line with the transgene expression data in FIGS. 4, 5, 6A, and 6B, IFNα was produced selectively in cultures treated with NG-615 and NG-641 (FIG. 10A). Flt3 ligand (FLT3L) was readily detected following NG-615 treatment but only very low levels were detected with other viruses, and these levels were similar to those induced by activating T-cells with anti-CD3/28 indicating that the Flt3L in NG-615 cultures was the transgene product. The results for other cytokines showed that, as with the tumour cell line inoculation study described in Example 3 (FIG. 7), NG-615 inoculation lead to much lower levels of T-cell activation than the other FAP-Bispecific T cell activator encoding viruses NG-617, NG-640 and the other 4-transgene-bearing virus NG-641, as shown for IFNγ, TNFα, IL-17, Granzyme B and IL-13 in FIG. 10B.

Activation of the endogenous tumour T-cells in an excised NSCLC tumour cell culture was also measured by flow cytometry, assessing levels of the T-cell activation markers CD25, CD69 and CD107a as well as intracellular cytokine (IFNγ and TNFα) expression by both CD4 and CD8 T-cells after 3 days of culture. As shown in FIG. 11A-11D, EnAd had little effect on either activation markers or cytokine expression, whereas NG-617, NG-640 and NG-641 treatments all led to upregulation of all these measured of T-cell activation. The similar levels of activation seen with the FAP-Bispecific T cell activator-bearing viruses is in line with the cytokine data described above (FIG. 10B)

Example 6

In this example, the ability of recombinant FAP Bispecific T cell activator-activated T-cells to induce death of the fibroblast target cells was evaluated.

FAP Bispecific T Cell Activator Induces T Cell-Mediated Lysis of FAP-Positive Cell Lines and Primary Cells NHDF (7,000 cells) were co-cultured with 70,000 T-cells in wells of a U-bottom 96 well plate in the presence of media alone or 300 ng/mL of control or FAP Bispecific T cell activator. After 24 hours of co-culture, supernatants were harvested and cytotoxicity determined by LDH assay following the manufacturer's instructions. The results are in FIG. 15, panel A show that the FAP Bispecific T cell activator significantly increased lysis of NHDF cells.

In a similar experiment, 7,000 primary lung fibroblast cells (BTC100) were co-cultured with 70,000 CD3+ T-cells with or without 300 ng/mL of control or FAP Bispecific T cell activator. After 24 hours of co-culture, supernatants were harvested and cytotoxicity determined by LDH assay. The results in FIGS. 15, panels B & C show that the FAP Bispecific T cell activator significantly increased lysis of primary human cancer associated fibroblast (CAF) cells. Expression of FAP by these and other patient-derived cell lines is shown in FIG. 16.

The dose-response relationship for FAP Bispecific T cell activator-mediated cell lysis was evaluated by co-culturing 8,000 NHDF cells with 40,000 T-cells and Bispecific T cell activator concentrations ranging from $2 \times 10^3$ to $2 \times 10^{-2}$ ng/mL. After co-culture for 24 hours at 37° C., an LDH assay was performed on supernatants to determine target cell cytotoxicity. Dose response curves were fitted using a four parameter non-linear fit model integrated into GraphPad Prism, generating an EC50 value for the FAP Bispecific T cell activator of 3.2 ng/mL. The results (FIG. 17A) show a dose-dependent relationship between FAP Bispecific T cell activator concentration and cytotoxicity as measured by LDH assay (shown as $Abs_{490}$).

Example 7

Stable FAP expressing CHO and Ad293 cell lines were generated as a means to demonstrate the FAP antigen specificity of the FAP Bispecific T cell activator by comparing to parental untransfected cells.

Generation of FAP-Expressing Stable-Transfected Cell Lines

The protein sequence of the FAP gene was obtained from the NCBI database (SEQ ID 23), reverse transcribed to generate a DNA coding sequence that was synthesised by Oxford Genetics Ltd (Oxford, UK). The FAP gene was cloned into pSF-Lenti vector by standard cloning techniques producing the pSF-Lenti-FAP vector. HEK293T cells were transfected with the lentivirus FAP expression vector alongside pSF-CMV-HIV-Gag-Pol, pSF-CMV-VSV-G, pSF-CMV-HIV-Rev. Lipofectamine 2000 was used as a transfection reagent and was added to the vector DNA at a DNA:lipofectamine ratio of 1:2, and incubated with the cells at 37° C. Supernatant containing lentivirus was harvested 48 hours later and mixed with polybrene (final concentration, 8 µg/mL). The Lentivirus/polybrene mixture was added to seeded Ad293 or CHO cells and incubated at 37° C. On day 4, the supernatant was exchanged for media containing puromycin (2 µg/mL for Ad293 and 7.5 µg/mL for CHO). Stable variants were then clonally selected and FAP expression of the parental cell lines or stable-transfected variant was determined by staining with FAP or isotope control antibody and analysed by flow cytometry (FIG. 18A).

FAP Bispecific T Cell Activator-Mediated Target Cell Lysis is Specific to FAP-Expressing Cells CHO or CHO-FAP cells (7,000 cells) were co-cultured alone or with human T-cells (70,000) in the presence of media alone or 2 µg/mL control or FAP Bispecific T cell activator in wells of a U-bottom 96-well plate. After 24 hours incubation, supernatants were harvested and target cell cytotoxicity measured by LDH cytotoxicity assay as described in example 4 (FIG. 18B). T-cell activation was also determined by analysing the expression levels of CD69 and CD25 via flow cytometry (FIG. 19). Cytotoxicity was only observed when CHO-FAP cells were cultured with T-cells and FAP Bispecific T cell activator. This indicates that FAP Bispecific T cell activator mediated T-cell activation and target cell lysis is highly specific and limited to FAP-expressing cells, and not the FAP-negative parental cell line.

Example 8

In a further experiment, the ability of the recombinant FAP Bispecific T cell activator protein to activate CD4 or CD8 T-cells and the ability of each of these T-cell subsets to lyse NHDF cells was assessed. CD3+ T-cells (35,000) were co-cultured with 7,000 NHDF cells in the presence of 300 ng/mL control or FAP Bispecific T cell activator in wells of a U-bottom 96 well plate, and incubated at 37° C. for 24 hours. Cells were harvested and stained with antibodies to CD4 or CD8 and CD69 and CD25, and analysed by flow cytometry. The results (FIG. 20, panel A) demonstrated that the FAP Bispecific T cell activator induced an increase in activation markers CD69 and CD25 in both CD4+ and CD8+ T-cells.

In a similar experiment, the ability of each T-cell subset (CD4 and CD8) to kill target cells was assessed. CD4+ T-cells were extracted from CD3-purified cells by positive selection using a CD4 T Cell Isolation Kit (Miltenyi Biotec, #130-045-101), according to the manufacturer's protocol, with the CD8 cells within non-isolated flow-through. In wells of a U-bottom 96-well plate, 7,000 NHDF were co-cultured with 35,000 CD4⁺ or CD8⁺ T-cells together with 300 ng/mL of control or FAP Bispecific T cell activator and incubated at 37° C. After 24 hours, supernatants were harvested and target cell cytotoxicity measured by LDH cytotoxicity assay. The results (FIG. 20, panel B) show that the FAP Bispecific T cell activator induced both CD4⁺ and CD8⁺ T-cells to kill NHDF cells.

Example 9

Characterising FAP Bispecific T Cell Activator-Mediated Activation of Autologous Tumour-Associated Lymphocytes from Primary Malignant Ascites To evaluate the activity of Bispecific T cell activator proteins using cancer patient derived cells, samples of primary malignant ascetic fluids containing both CD3⁺ T-cells and FAP⁺ cells were obtained for testing. Unpurified ascites cells (therefore unchanged from when received) were seeded at 250,000 cells per well of a U-bottom 96-well plate in either 100% ascites fluid or medium supplemented with 1% human serum in the presence of 500 ng/mL control or FAP Bispecific T cell activator. Untreated wells served as negative controls. After incubation at 37° C. for 5 days, the total cell population was harvested and the numbers of CD3⁺ T-cells (FIG. 21, panel A) and expression levels of CD25 on CD3⁺ T-cells were determined (FIG. 21, panel B). Total cell numbers per well were determined using precision counting beads. The results demonstrate that the FAP Bispecific T cell activator resulted in significant increase in T-cell activation of the tumour-associated T-cells from cancer patients.

As an extension of the experiment above, replicate wells were harvested and the number of FAP⁺ cells determined by flow cytometry (FIG. 21, panel C). Total cell numbers per well were determined using precision counting beads. The results show that the FAP Bispecific T cell activator resulted in a significant decrease in numbers of autologous FAP-expressing cells in the ascites sample.

Example 10

Recombinant Bispecific T Cell Activator-Expressing EnAd Viruses were Engineered, Produced and Purified Using the Methods Described Below.

Generation of Bispecific T cell activator-expressing Enadenotucirev EnAd is a replication competent chimeric group B adenovirus that contains frequent non-homologous nucleotide substitutions of Ad3 for Ad11p in the E2B region, a nearly complete E3 deletion and a smaller E4 deletion mapped to E4orf4 (Kuhn et al, Directed evolution generates a novel oncolytic virus for the treatment of colon cancer, PLoS One, 2008 Jun. 18; 3(6): e2409).

The plasmid pEnAd2.4 was used to generate the plasmids ppEnAd2.4-CMV-FAP Bispecific T cell activator, pEnAd2.4-SA-FAP Bispecific T cell activator, pEnAd2.4-CMV-ControlBispecific T cell activator, pEnAd2.4-SA-Control Bispecific T cell activator (Table 4) by direct insertion of a cassette encoding the FAP Bispecific T cell activator (SEQ ID NO: 1) or Control Bispecific T cell activator (SEQ ID NO: 3). The transgene cassette contained a 5' short splice acceptor sequence CAGG or an exogenous CMV promoter (SEQ ID NO: 24), the EpCAM, FAP or control Bispecific T cell activator cDNA sequence and a 3' polyadenylation sequence (SEQ ID NO: 25). Construction of the plasmid was confirmed by DNA sequencing. The exogenous CMV promoter is constitutively active and thus leads to early expression of transgenes. The splice acceptor sequence drives expression under the control of the viral major late promoter and leads to later transgene expression following initiation of virus genome replication.

TABLE 4

| Plasmid ID | [plasmid DNA] ng/ml |
|---|---|
| pEnAd2.4-CMV-FAP Bispecific T cell activator | 1322.8 |
| pEnAd2.4-SA-FAP Bispecific T cell activator | 3918.3 |
| pEnAd2.4-CMV-Control Bispecific T cell activator | 189.1 |
| pEnAd2.4-SA-Control Bispecific T cell activator | 236.2 |
| pEnAd2.4-CMV-FAP Bispecific T cell activator-RFP | 1599 |
| pEnAd2.4-SA-FAP Bispecific T cell activator-RFP | 1872 |
| pEnAd2.4-CMV-Control Bispecific T cell activator-RFP | 1294 |
| pEnAd2.4-SA-Control Bispecific T cell activator-RFP | 2082 |

Virus Production and Characterisation

The plasmids EnAd2.4-CMV-EpCAMBispecific T cell activator, pEnAd2.4-SA-EpCAMBispecific T cell activator, pEnAd2.4-CMV-FAP Bispecific T cell activator, pEnAd2.4-SA-FAP Bispecific T cell activator, pEnAd2.4-CMV-ControlBispecific T cell activator, pEnAd2.4-SA-ControlBispecific T cell activator were linearised by restriction digestion with the enzyme AscI to produce the liner virus genome. Digested DNA was purified by isopropanol extraction and precipitated for 16 hrs, −20° C. in 300 µl>95% molecular biology grade ethanol and 10 µl 3M Sodium Acetate. The precipitated DNA was pelleted by centrifuging at 14000 rpm, 5 mins and was washed in 500 µl 70% ethanol, before centrifuging again, 14000 rpm, 5 mins. The clean DNA pellet was air dried and resuspended in 100 µL water. 6.25 µg DNA was mixed with 15.6 µL lipofectamine transfection reagent in OptiMEM and incubated for 20 mins, RT. The transfection mixture was then added to a T-25 flask containing Ad293 cells grown to 80% confluency. After incubation of the cells with the transfection mix for 4 hrs at 37° C., 5% $CO_2$, 4 mls of cell media (DMEM high glucose with glutamine supplemented with 10% FBS) was added to the cells and the flasks was incubated 37° C., 5% $CO_2$. The transfected Ad293 cells were monitored every 24 hrs and were supplemented with additional media every 48-72 hrs. The production of virus was monitored by observation of a significant cytopathic effect (CPE) in the cell monolayer. Once extensive CPE was observed the virus was harvested from Ad293 cells by three freeze-thaw cycles. Single virus clones were selected by serial diluting harvested lysate and re-infecting Ad293 cells, and harvesting wells containing single plaques. Serial infections of Ad293 cells were performed once an infection had reached full CPE in order to amplify the virus stocks. Viable virus production during amplification was confirmed by observation of significant CPE in the cell monolayer.

Virus Purification

Once potent virus stocks were amplified the viruses were purified by double caesium chloride density gradient centrifugation (banding) to produce, NG-603, NG-604, NG-605 and NG-606 virus stocks. These stocks were titred by micoBCA assay (Life Technologies), following manufacturer's instructions (Table 5).

TABLE 5

| EnAd ID | NG ID NO: | Virus Genome SEQ ID | vp/mL | TCID50/ mL |
|---|---|---|---|---|
| EnAd-CMV-Control Bispecific T cell activator | NG-603 | | $1.42607 \times 10^{12}$ | $5.01 \times 10^{10}$ |
| EnAd-SA-Control Bispecific T cell activator | NG-604 | | $3.31073 \times 10^{12}$ | $2.00 \times 10^{11}$ |
| EnAd-CMV-FAP Bispecific T cell activator | NG-605 | SEQ ID NO: 26 | $1.64653 \times 10^{12}$ | $1.58 \times 10^{11}$ |
| EnAd-SA-FAP Bispecific T cell activator | NG-606 | SEQ ID NO: 27 | $1.28148 \times 10^{12}$ | $3.98 \times 10^{10}$ |
| EnAd-CMV-Control Bispecific T cell activator-P2A-RFP | NG-607 | | $5.963 \times 10^{12}$ | $1.26 \times 10^{9}$ |
| EnAd-SA-Control Bispecific T cell activator-P2A-RFP | NG-608 | | $1.51848 \times 10^{12}$ | $6.31 \times 10^{9}$ |
| EnAd-CMV-FAP Bispecific T cell activator-P2A-RFP | NG-609 | | $1.57517 \times 10^{12}$ | $7.94 \times 10^{9}$ |
| EnAd-SA-FAP Bispecific T cell activator-P2A-RFP | NG-610 | | $7.74881 \times 10^{11}$ | $5.01 \times 10^{10}$ |

Example 11

The activities of NG-601, NG-602, NG-603, NG-604, NG-605 and NG-606 viruses were characterised using the methods described below.

Characterisation of Bispecific T Cell Activator Encoding EnAd Activity Compared to EnAd in Carcinoma Cell Lines The ability NG-601, NG-602, NG-603, NG-604, NG-605, NG-606 or EnAd to replicate was analysed by infection of A549 lung carcinoma cells and assessed by qPCR. A549 cells were seeded in wells of a 24-well plate at a cell density of $2 \times 10^5$ cells/well. Plates were incubated for 18 hrs, 37° C., 5% $CO_2$, before cells were either infected with 100 virus particles per cell (ppc) or were left uninfected. Wells were harvested 24, 48 or 72 hrs post infection and DNA purified using PureLink genomic DNA mini kit (Invitrogen) according to the manufacturer's protocol. Total viral genomes were quantified by qPCR with each extracted sample or standard using an EnAd hexon gene specific primer-probe set in the reaction mix detailed in Table 6. qPCR was performed as per the programme in Table 7.

TABLE 6

| Reagent | Volume/well (µl) |
|---|---|
| 2 × qPCRBIO Probe Mix (PCRBiosystems) | 10 |
| EnAd Forward primer | 0.08 |
| EnAd Reverse primer | 0.08 |
| EnAd Probe | 0.8 |
| NFW | 4.04 |
| Sample | 5 |
| Well Volume | 20 |

TABLE 7

| No. Cycles | Temperature (° C.) | Duration (secs) |
|---|---|---|
| 1 | 95 | 120 |
| 40 | 95 | 5 |
| | 60-65 | 20-30 |

Quantification of the number of detected virus genomes per cell demonstrated that NG-601, NG-602, NG-603, NG-604, NG-605, NG-606 and EnAd virus replication were comparable in the A549 cell line (FIG. 22, panel A).

Oncolytic activity of NG-601, NG-602, NG-603, NG-604, NG-605, NG-606 or EnAd was assessed by infection of A549 (FIG. 22, panel B). A549 cells were seeded in 96-well plate at a cell density of $1.5 \times 10^4$ cells/well. Plates were incubated for 18 hrs, 37° C., 5% $CO_2$, before cells were infected with increasing ppc of virus (5-fold serial dilution, $4.1 \times 10^{-7}$ to 5000 virus ppc) or were left uninfected. A549 cytotoxicity was measured on day 5 by CellTiter 96® AQueous One Solution Cell Proliferation Assay (MTS) (Promega, #G3582). Dose response curves were fitted using a four parameter non-linear fit model integrated into Graph-Pad Prism. IC50 values generated for each virus demonstrated that the oncolytic activities of NG-601, NG-602, NG-603, NG-604, NG-605, NG-606 and EnAd was comparable for each virus.

Confirmation of Functional Bispecific T Cell Activator Transgene Expression from NG-603, NG-604, NG-605, NG-606

To determine whether the viruses NG-601, NG-602, NG-605, NG-606 produced functional Bispecific T cell activators, T-cell activation assays using CHO, CHO-EpCAM and CHO-FAP cell lines as target cells were performed. 10,000 target cells were co-cultured with 50,000 CD3+ T-cells in wells of a U-bottom 96-well plate with Ad293 viral supernatants diluted 100-fold in culture medium and incubated for 24 hrs, 37° C., 5% $CO_2$. T-cells were harvested and stained with antibodies specific for CD25 and CD69 and analysed by flow cytometry. The results (FIGS. 23A and 23B) indicated that the viruses NG-601 and NG-602 expressed a functional Bispecific T cell activator transgene that activated T cells when co-cultured with CHO-EpCAM cells, and NG-605 and NG-606 expressed a functional Bispecific T cell activator transgene that activated T cells when co-cultured with CHO-FAP cells, but not when co-cultured with CHO cells.

Quantification of Bispecific T Cell Activator Expression in a Colon Carcinoma Cell Line The quantity of Bispecific T cell activator expression by NG-601, NG-602, NG-605, NG-606 infection of the human colon carcinoma cell line DLD was assessed. DLD cells were seeded in 6 well culture plates at a density of $1.2 \times 10^6$ cells per well. 18 hrs post-seeding, DLD cells were infected with EnAd, NG-601, NG-602, NG-603, NG-604, NG-605, NG-606 at 100 ppc. Cells were cultured for 72 hrs before the supernatants were collected from the wells and centrifuged for 5 mins, 1200 rpm to remove cell debris. The clarified supernatants were then used for a killing assay, with cytotoxicity compared to a standard curve generated with a recombinant Bispecific T cell activator of known concentration, allowing determination of quantity of Bispecific T cell activator in viral supernatants.

To determine the quantity of FAP Bispecific T cell activator produced from NG-605 and NG-606, a cytotoxicity assay was performed in which 8,000 NHDF were co-cultured with 40,000 CD3+ T-cells and DLD viral supernatants diluted 1 in $10^3$, 1 in $10^4$ and 1 in $10^5$. A standard curve was generated by incubating NHDF and CD3+ T-cells with FAP or control Bispecific T cell activator at 10-fold serial dilutions from 3333 to $3.33 \times 10^{-4}$ ng/L. Supernatants were harvested 24 hour post-treatment and cytotoxicity measured by LDH assay. Quantity of Bispecific T cell activator expressed was determined by comparing cytotoxicity of viral supernatants to that of the recombinant Bispecific T cell activator standard curve. The results (FIG. 24) indicated that the viruses NG-605 and NG-606 produced 9.8 and 49.2 µg FAP Bispecific T cell activator per million DLD cells, respectively.

Example 12

In addition to encoding a FAP or Control Bispecific T cell activator, the NG-607, NG-608, NG-609, NG-610 viruses also carry a red fluorescent protein (RFP) transgene for visualization of infected cells using fluorescent microscopy methods (SEQ ID NOS: 20 & 21 Table 4). The functional activities of these viruses were characterised using the methods described below.

Confirmation of Transgene Expression from NG-607, NG-608, NG-609, NG-610

The ability of viruses NG-607, NG-608, NG-609 and NG-610 to produce their Bispecific T cell activator transgene was assessed by infection of Ad293 cells. Ad293 cells were plated in a 6-well plate at $1\times10^6$ cells/well. Plates were incubated for 24 hrs, 37° C., 5% $CO_2$, before cells were infected with viruses at 100 ppc or were left uninfected. At 48 hours post-infection, plaques were irradiated with a fluorescent mercury lamp and photographed (FIGS. 18A-18B). The results suggested that the viruses NG-607, NG-608, NG-609 and NG-610 express the RFP transgene.

Example 13

In the next series of experiments, the ability of EnAd and FAP or control Bispecific T cell activator viruses NG-603, NG-604, NG-605, NG-606, NG-607, NG-608, NG-609, NG-610 to kill target cells, including tumour cells and fibroblasts, was evaluated.

In the first study, the ability of EnAd to kill DLD cells was assessed using xCELLigence technology. DLD cells were plated in a 48-well E-plate at $1.2\times10^4$ cells/well and incubated for 18 hrs, 37° C., 5% $CO_2$, before cells were either infected with 100 EnAd ppc or were left uninfected. XCELLigence was used to measure target cell cytotoxicity every 15 minutes over an 8 day incubation period.

In a similar experiment, the ability of NG-603, NG-604, NG-605, NG-606 and EnAd to kill NHDF cells was assessed in co-culture with SKOV tumour cells and CD3+ T-cells using xCELLigence. NHDF cells and SKOV cells were seeded in a 48-well E-plate at $4\times10^3$ and $1\times10^3$ cells/well, respectively. Plates were incubated for 18 hrs, 37° C., 5% $CO_2$, before cells were either infected with 100 ppc of EnAd, of NG-603, NG-604, NG-605 or NG-606 or were left uninfected. After 2 hour incubation, 37,500 CD3+ T-cells were added to each well. xCELLigence was used to measure target cell cytotoxicity every 15 minutes. The results (FIG. 26A) demonstrate that the FAP Bispecific T cell activator-expressing viruses NG-605 and NG606, but not EnAd or control Bispecific T cell activator-expressing viruses NG-603 and NG-604, were able to induce lysis of NHDF cells, with kinetics dependent on the promoter used for Bispecific T cell activator expression (faster with CMV promoter).

In a similar experiment, the ability of NG-603, NG-604, NG-605, NG-606 and EnAd to kill NHDF cells, was assessed in co-culture with SKOV and CD3+ T-cells using LDH cytotoxicity assay. NHDF cells and SKOV cells were seeded in a 96-well U-bottom plate at $8\times10^3$ and $2\times10^3$ cells/well, respectively, and either infected with 100 ppc of EnAd, of NG-603, NG-604, NG-605 or NG-606 or were left uninfected. After 2 hour incubation, 75,000 CD3+ T-cells were added to each well and plates were incubated at 37° C., 5% $CO_2$. Supernatants were harvested at 0, 24, 48 and 96 hours post-treatment and cytotoxicity measured by LDH cytotoxicity assay. The results (FIG. 26B) demonstrate that the FAP Bispecific T cell activator-expressing viruses NG-605 and NG606, but not EnAd or control Bispecific T cell activator-expressing viruses NG-603 and NG-604, were able to induce lysis of NHDF cells, with kinetics dependent on the promoter used for Bispecific T cell activator expression.

As an extension of the LDH experiment above, the cells were also harvested at 0, 24, 48 and 96 hours post-treatment, stained with antibodies for CD45, CD69 and CD25 and analysed by flow cytometry. The results (FIG. 27) demonstrate that the FAP Bispecific T cell activator-expressing viruses NG-605 and NG-606, but not EnAd or control Bispecific T cell activator-expressing viruses NG-603 and NG-604, were able to induce T-cell activation, with kinetics dependent on the promoter used for Bispecific T cell activator expression.

In a similar experiment, the dependence on FAP to induce FAP Bispecific T cell activator-mediated T-cell activation was evaluated. In a 96-well U-bottom plate, SKOV cells were seeded at $2\times10^3$ cells/well alone or in combination with NHDF cells at $8\times10^3$ cells/well. Viral particles were added to each well at 100 ppc, and plates incubated at 37° C., 5% $CO_2$. After two hours, 75,000 CD3+ T-cells were added and plates incubated further. At 96-hours post-infection, cells were harvested and stained for CD45 and CD25 and analysed by flow cytometry (FIG. 28, panel A). The results demonstrate that the FAP Bispecific T cell activator-expressing viruses NG-605 and NG-606, only induced T-cell activation in the presence of FAP-positive NHDF cells.

In a similar experiment, the specificity of promoter (CMV or virus MLP/SA)-driven Bispecific T cell activator expression in NG-605 and NG-606 was investigated further. In a 96-well U-bottom plate, NHDF cells were seeded at $4\times10^3$ cells/well. 100 viral particles per cell were added to each well, and plates incubated at 37° C., 5% $CO_2$. After two hours, 40,000 CD3 cells were added and plates incubated further. At 72-hours post-infection, supernatants were harvested and cytotoxicity measured by LDH cytotoxicity assay. The results (FIG. 28, panel B) demonstrate that the CMV-driven virus NG-605, but not SA-driven NG-606, was able to mediate killing of NHDF cells upon infection of NHDF cells alone.

The results indicate that NG-605 and NG-606 were both able to induce T cell activation and target cell lysis, although the kinetic profile was slightly different depending on the promoter used. Timelapse videos were obtained to observe viral or T cell-mediated lysis of target cells by recombinant FAP Bispecific T cell activator, EnAd, NG-603 or NG-605. NHDF cells were stained with CellTracker Orange CMTMR Dye (Life Tech, #C2927) and CD3+ T-cells were stained with CellTrace Violet Cell Proliferation Kit (Life Tech, #C34557) following manufacturer's protocols. Dyed NHDF were plated in a 24-well plate at $7.5\times10^3$ cells/well in co-culture with $1.35\times10^4$ DLD or SKOV tumour cells. Plates were incubated for 18 hrs, 37° C., 5% $CO_2$. Cells were then treated with 300 ng/mL FAP Bispecific T cell activator or infected with 100 ppc of EnAd, NG-603, and NG-605 or left untreated. After two hours incubation, 100,000 dyed CD3+ T-cells were added to necessary wells, in addition to 1.5 µM CellEvent Caspase 3-7 reagent (Life Tech, #C10423). Videos were obtained on a Nikon TE 2000-E Eclipse inverted microscope, with images captured every 15 minutes for 96 hours. Frames from the videos are shown in FIG. 29. The results show that the recombinant FAP Bispecific T cell activator and NG-605, but not EnAd or NG-603, were able to induce rapid lysis of NHDF cells.

In a similar experiment, NHDF cells were stained with CellTracker Green CMFDA Dye (Life Tech, #C2925) and CD3+ T-cells were stained with CellTrace Violet Cell Proliferation Kit (Life Tech, #C34557) following manufacturer's protocols. Dyed NHDF were plated in a 24-well plate at $7.5 \times 10^3$ cells/well in co-culture with $1.35 \times 10^4$ DLD or SKOV tumour cells. Plates were incubated for 18 hrs, 37° C., 5% $CO_2$. Cells were then infected with 100 ppc of NG-607, NG-608, NG-609 or NG-610 or left uninfected. After two hours incubation, 100,000 dyed CD3+ T-cells were added to necessary wells. Videos were obtained on a Nikon TE 2000-E Eclipse inverted microscope, with images captured every 15 minutes for 96 hours. Frames from the videos are shown in FIG. 30. The results show that all viruses lead to tumour cell infection (RFP, red fluorescence, positive), but only NG-609 and NG-610 were able to induce rapid lysis of the co-cultured NHDF cells.

Example 14

In this example, the activation of autologous tumour-associated lymphocytes from FAP+ primary malignant ascites from cancer patients by EnAd, NG-603, NG-604, NG-605 and NG-606 was evaluated. Patient samples considered suitable for further analysis were those containing CD3+ T-cells and FAP+ cells.

In the first experiment, unpurified (therefore unchanged from when received) ascites cells from a patient were seeded at 250,000 cells per well of a U-bottom 96-well plate in 100% ascites fluid. Cells were infected with viruses at 100 ppc, with untreated wells serving as negative controls. EnAd-CMV-GFP and EnAd-SA-GFP were also included in the experiment as a reporter to determine infection and late stage viral gene expression, respectively, with micrographs. After incubation at 37° C. for 5 days, the total cell population was harvested and the expression level of CD25 on CD3+ T-cells (FIG. 32, panel A) was determined. Total cell numbers per well were determined using precision counting beads. The results demonstrate that the FAP Bispecific T cell activator viruses NG-605 and NG-606 resulted in significant increases in T-cell activation of tumour-associated lymphocytes.

As an extension of the experiment above, replicate wells were harvested and the number of endogenous FAP+ cells determined by flow cytometry. Total cell numbers per well were determined using precision counting beads. The results (FIG. 40, panel B) show that NG-605 and NG-606 resulted in a significant decrease in numbers of autologous FAP-expressing cells in the ascites samples, suggesting some FAP+ cells had been killed by the activated T-cells.

In a second experiment, unpurified (therefore unchanged from when received) ascites cells from a cancer patient were seeded at 250,000 cells per well of a U-bottom 96-well plate in either 100% ascites fluid or medium supplemented with 1% human serum. Cells were infected with viruses at 100 ppc, with untreated wells serving as negative controls. EnAd-CMV-GFP and EnAd-SA-GFP were also included as a reporter to determine infection and late stage viral gene expression, respectively, with micrographs. After incubation at 37° C. for 5 days, the total cell population was harvested and the number of CD3+ T-cells (FIG. 33) and expression level of CD25 on CD3+ T-cells (FIG. 34) was determined. Total cell numbers per well were determined using precision counting beads. The results demonstrate that for this patient recombinant FAP Bispecific T cell activator and NG-605, but not NG-606, resulted in significant increase in T-cell activation of tumour-associated lymphocytes in media. Neither virus led to activation in ascites fluid.

As an extension of the experiment above, replicate wells were harvested and the number of FAP+ cells was determined by flow cytometry (FIG. 35). Total cell numbers per well were determined using precision counting beads. The results demonstrate that recombinant FAP Bispecific T cell activator and NG-605, but not NG-606, resulted in a significant decrease in numbers of autologous FAP-expressing cells in media. Neither virus led to a reduction in FAP+ cells in ascites fluid.

Example 15—Discussion

Oncolytic viruses offer an intriguing new strategy to combine several therapeutic modalities within a single targeted, self-amplifying, agent (Keller & Bell, 2016; Seymour & Fisher, 2016). As they replicate selectively within cancer cells and spread from cell to cell, some oncolytic viruses are thought to mediate cell death by non-apoptotic death pathways (Ingemarsdotter et al, 2010; Li et al, 2013), as part of the process allowing virus particles to escape from dying cells. EnAd, in particular, kills cells by a pro-inflammatory process known as oncosis or ischemic cell death (Dyer, 2017). This non-apoptotic death mechanism causes release of several pro-inflammatory cellular components, such as ATP, HMGB1 and exposure of calreticulin (known as damage-associated molecular patterns, DAMPs) (Weerasinghe & Buja, 2012), and is likely pivotal to the ability of the virus to promote an effective anticancer immune response. In addition to the consequences of direct lysis, however, viruses offer the potential to encode and express other anticancer biologics, obviating delivery challenges and ensuring the biologic achieves its highest concentration within the tumour microenvironment. Imlygic encodes GM-CSF, however the potential for arming viruses is virtually limitless and provides many exciting opportunities to design multimodal therapeutic strategies with additive or synergistic anticancer effects (de Gruijl et al, 2015; Hermiston & Kuhn, 2002).

Encoding Bispecific T cell activators within oncolytic viruses provides a powerful means to activate tumour infiltrating lymphocytes to become cytotoxic and lyse antigen-positive target cells, providing a completely separate therapeutic modality from the effects of direct viral lysis. In this study we have shown that Bispecific T cell activator-targeted cytotoxicity is fully antigen-specific, can be mediated by both CD4 and CD8 T cells (Brischwein et al, 2006) and can be incorporated into an oncolytic adenovirus and expressed only in cells that allow virus replication. In addition, the current study shows, for the first time, that endogenous T cells within liquid cancer biopsies can be activated by Bispecific T cell activators and virus-encoded Bispecific T cell activators and can kill endogenous tumour cells without any additional stimulation or reversal of immune suppression. Importantly, this can happen even in the primary fluids that comprise the microenvironment of peritoneal ascites or pleural effusions, as surrogates for the immune suppressive microenvironment of solid tumours.

Arming oncolytic viruses to express Bispecific T cell activators combines two quite distinct therapeutic mechanisms, with the former providing lytic death of tumour cells that are permissive for virus infection, and the latter targeting T cell cytotoxicity via a specific, chosen, antigen. This provides considerable flexibility in the design of a therapeutic approach, perhaps using the Bispecific T cell activators to deliver cytotoxicity to tumour-associated cells that are relatively resistant to kill by the virus directly. For example, while we have exemplified the technology here using a Bispecific T cell activator that recognises a carcinoma-associated antigen (EpCAM), it is also possible to use the Bispecific T cell activator approach to target cytotoxicity to tumour-associated fibroblasts or other stromal cells. Indeed, even when the targets for Bispecific T cell activator-recognition are not restricted to expression in the tumour microenvironment, by linking Bispecific T cell activator production to virus replication allows expression of the Bispecific T cell activator to be spatially restricted to the tumour, minimising systemic toxicities. This is important, as Bispecific T cell activators administered intravenously show relatively short circulation kinetics (Klinger et al, 2012) and are often associated with considerable on-target off-tumour toxicities (Teachey et al, 2013).

The possibility to encode Bispecific T cell activators within oncolytic viruses has been previously explored using an oncolytic vaccinia virus with an Ephrin A2-targeting Bispecific T cell activator. This agent showed that the Ephrin Bispecific T cell activator could mediate activation of PBMCs and antigen-targeted killing of tumour cells both in vitro and in vivo. Intriguingly, although the Bispecific T cell activator could activate T cells it did not lead to T cell proliferation without the addition of exogenous IL-2, whereas the Bispecific T cell activator used in the current study led to extensive proliferation both of PBMC in vitro and of tumour-associated lymphocytes using the clinical biopsy samples ex vivo.

We believe that the differences observed may reflect the different Bispecific T cell activator design, the different oncolytic virus used or perhaps depend on the antigen density giving sufficient crosslinking of CD3 on the T cells.

One central aim of oncolytic virus therapy is to create an anticancer T cell response that recognises patient specific neoantigens as well as "public" tumour associated antigens. Lytic viruses may do this by stimulating improved antigen presentation by lysing tumour cells in the context of DAMPs alongside virus-related pathogen-associated molecular patterns (PAMPs). Immunohistochemical staining of resected colon tumours, following intravenous delivery of EnAd, suggest the virus promotes a strong influx of CD8+ T cells into tumour tissue (Garcia-Carbonero, 2017). However, while this is potentially a very powerful approach, adaptive T cell responses are ultimately dependent on the expression of MHC class I antigens by tumour cells, to allow targeted killing. Loss of MHC expression is a well documented immune evasion strategy for tumours (Garrido et al, 2016). It is noteworthy that both cytotoxic strategies that are immediately engaged by Bispecific T cell activator-armed oncolytic viruses operate independently of MHC class I by the tumour cells, and therefore can be employed to kill cancer cells even when tumour cells have lost MHC expression. The present study thus demonstrates that encoding Bispecific T cell activators within EnAd provides a particularly promising strategy to achieve targeted expression in disseminated tumours, exploiting the known blood-stability and systemic bioavailability of the virus, which has now been studied in several early phase clinical trials. Notably, in a study where the virus is given intravenously a few days prior to resection of primary colon cancer, subsequent immunohistological assessment of tumour sections showed that the virus had reached to regions through the tumours and gave strong intranuclear hexon signals, indicating successful infection and virus replication selectively in tumour cells. This confirms preclinical data (Di et al, 2014; Illingworth, 2017) indicating that this virus is stable in 100% human blood and should be capable of tumourtargeted infection of disseminated and metastatic malignancies in human patients.

Bispecific T cell activators could be encoded by EnAd without any loss of oncolytic virulence, reflecting the considerable transgene packaging capacity of the virus. The presence of the transgene will not affect the physicochemical properties of the virus particles, hence the modified viruses should exhibit exactly the same clinical pharmacokinetics as the parental agent, and should be capable of expressing the encoded Bispecific T cell activator selectively within tumours throughout the body. This provides an exciting and potentially very effective new approach to systemically targeted cancer immunotherapy that should now be prioritised for clinical assessment Example 16

Immunosuppression of Human T-Cell Activation and Target Cell Cytotoxicity by Patient Malignant Exudate Fluids Malignant exudates represent an environment of potential immune tolerance with suppressed immune responses commonly observed in patients with late-stage metastatic cancer. The quantity of IL-10, considered to be an anti-inflammatory cytokine, was measured in normal serum or patient malignant exudate fluids (A, peritoneal ascites; P, pleural effusion) using Human IL-10 ELISA MAX kit (Biolegend, 430604). IL-10 levels in the exudates (88.1-633.4 pg/mL) were far in excess of those measured in normal serum (7.2-10 pg/mL).

The ability of CD3/CD28 beads (Gibco, 11161D) to activate PBMC T-cells in the presence of normal serum, ascites or pleural fluid was investigated. Human PBMC T-cells (100,000 cells per well in 96 well plate) were treated with CD3/CD28 beads (following manufacturers instructions) in normal serum or patient exudate fluid (50%). T-cells were left untreated in each fluid as negative control. After 24 hours of culture, cells were harvested and the expression levels of CD69 and CD25 on CD3+ T-cells were then analysed by antibody staining and flow cytometry represented as percentage of dual positive (CD69+CD25+ cells). In normal serum the anti-CD3/CD28 beads gave approximately 60% of T cells dual positive for both CD25 and CD69, whereas the presence of ascites fluid attenuated T cell activation in 6/12 fluids.

In a similar experiment, 100,000 T-cells were treated with CD3/CD28 beads in the presence of normal serum, ascites or pleural fluid (50%). Anti-CD107a or isotype control antibody were added directly to culture medium. After 1 hour, monensin was added (BD Golgistop, BD Biosciences) according to manufacturers instructions. After 5 further hours, cells were harvested and analysed by flow cytometry to determine degranulation. In normal serum the anti-CD3/CD28 beads gave approximately 22.5% of T cells degranulated, whereas the presence of ascites fluid attenuated T cell activation in 10/12 fluids. The level of degranulation was significantly correlative (Pearson co-efficient, r=−0.7645; p=0.0038) with quantity of IL-10 in each fluid.

In a similar experiment, 75,000 T-cells were co-cultured with 15,000 SKOV3 and EpCAM in the presence of normal serum, ascites or pleural fluid (50%). T-cells were treated with control Bispecific T cell activator in each fluid as negative control. After 24 hours of culture, cells were harvested and the expression levels of CD69 and CD25 on CD3+ T-cells were then analysed by antibody staining and flow cytometry represented as percentage of dual positive (CD69+CD25+ cells). In normal serum the EpCAM Bispecific T cell activator gave approximately 67.6% of T cells dual positive for both CD25 and CD69, whereas the presence of ascites fluid attenuated T cell activation in 0/12 fluids, and slightly induced activation in 4/10 fluids.

In a similar experiment, 75,000 T-cells were co-cultured with 15,000 SKOV3 and EpCAM in the presence of normal serum, ascites or pleural fluid (50%). T-cells were treated with control Bispecific T cell activator in each fluid as negative control. Anti-CD107a or isotype control antibody were added directly to culture medium. After 1 hour, monensin was added (BD Golgistop, BD Biosciences) according to manufacturers instructions. After 5 further hours, cells were harvested and analysed by flow cytometry to determine degranulation. In normal serum the EpCAM Bispecific T cell activator beads gave approximately 41.4% of T cells degranulated, whereas the presence of ascites fluid attenuated T cell activation in 2/12 fluids.

The ability of EnAd-SA-EpCAM Bispecific T cell activator and EnAd-SA-Control Bispecific T cell activator to induce T cell-mediated target cell lysis in malignant exudate fluids was assessed using xCELLigence technology. SKOV cells were plated in 48-well E-plate at 1e4 cells/well respectively. Plates were incubated for 18 hrs, 37° C., 5% C02, before cells were either infected with 100 virus particles per cell (ppc) or were left uninfected. After two hours, PBMC T-cells (5:1) in normal serum or patient exudate fluid (final, 50%) were added. xCELLigence was used to measure target cell cytotoxicity every 10 minutes. The results suggest that Bispecific T cell activator-mediated SKOV3 lysis by T-cells is independent of fluid used.

Unpurified ascites cells (therefore unchanged from when received) are seeded at 100,000 cells per well of a flat-bottom 96-well plate in RPMI media or ascites fluid. Cells were treated with EpCAM or control Bispecific T cell activator, with untreated wells serving as a negative control. After incubation at 37 C for 24 hours, cells were harvested, and the expression level of CD25 and CD69 on CD3 cells determined. The results demonstrate that EpCAM Bispecific T cell activator resulted in significant increase in T-cell activation (CD69/CD25 dual positive) of tumour-associated lymphocytes, slightly increased by ascites fluid.

In a similar experiment, unpurified ascites cells (therefore unchanged from when received) are seeded at 100,000 cells per well of a flat-bottom 96-well plate in RPMI media or ascites fluid. Cells were treated with EpCAM, control Bispecific T cell activator or recombinant Bispecific T cell activator viruses (100 vp/cell), with untreated wells serving as a negative control. After incubation at 37 C for 5 days, the total cell population was harvested, and the number of CD3+ cells and expression level of CD25 on CD3 cells determined and the number of endogenous EpCaM+ cells determined by flow cytometry. Total cell numbers per well were determined using precision counting beads. The results demonstrate that EpCAM Bispecific T cell activator and EnAd expressing EpCAM Bispecific T cell activator resulted in significant increase in T-cell activation (CD3 number, CD25) of tumour-associated lymphocytes and cytotoxicity of EpCAM+ cells in both RPMI media and ascites fluid.

As an extension of the experiment above, six more patient exudate samples (for a total of 7) were treated identically in ascites fluid and number of CD3+, CD25 expression of T-cells and number of EpCAM+ cells determined by flow cytometry. The results show that EpCAM Bispecific T cell activator and EnAd expressing EpCAM Bispecific T cell activator resulted in significant increase in T-cell activation (CD3 number, CD25) of tumour-associated lymphocytes and cytotoxicity of EpCAM+ cells reproducibly in a range of exudate biopsy samples.

Example 17

FAP Bispecific T Cell Activator Mediate Activation of T-Cells and Killing of FAP+ Cells by Different Donor T-Cells In other experiments, methods described in Example 2 were used to further evaluate the T-cell activating properties of recombinant FAP Bispecific T cell activator protein tested in co-cultures of NHDF and T-cells, comparing to control Bispecific T cell activator and polyclonal T-cell activation using anti-CD3/CD28 Dynabeads.

Supernatants taken after 24 hours of culture were tested by ELISA for IFNγ (FIG. 36, panel A) and by cytokine bead array (LEGENDplex human T helper cytokine panel, BioLegend #74001) for a panel of cytokines (FIG. 36, panel B). The control Bispecific T cell activator induced no significant change in any cytokine, however the FAP-Bispecific T cell activator led to strong increases in gamma interferon, IL-2, TNFα, IL-17 and IL-10, consistent with different subsets of T-cells being stimulated, and production of IFNγ was far greater than that triggered by anti-CD3/CD28.

Stimulation with the FAP Bispecific T cell activator, but not control Bispecific T cell activator, in the presence of NHDF cells also induced rapid degranulation (within 6 hr) of T-cells, both CD4+ and CD8+ subsets, as determined by the externalisation of CD107a/LAMP1 on the T-cell surface (as assessed by flow cytometry), which is strongly correlative with their ability to kill target cells (FIGS. 37, panels A and B). This induction of degranulation by the FAP Bispecific T cell activator translated to potent fibroblast lysis (FIG. 37, panel C), as measured by LDH release after 24 h co-culture with PBMC T-cells ($EC_{50}$ of ~2.5 ng/mL) with induced T-cell activation and cytotoxicity observed using 6/6 donor T-cells (FIG. 37, panel D). No cytotoxicity was induced by the control Bispecific T cell activator, consistent with T-cells remaining in an inactivated state.

Example 18

Effect of FAP Bispecific T Cell Activator and EnAd-FAP Bispecific T Cell Activator Viruses on Cells in Primary Malignant Ascites Samples from Different Ancer Patients As a follow-on to studies described in Example 16, fresh primary malignant peritoneal ascites from further cancer patients were obtained for study of EnAd FAP Bispecific T cell activator virus activities. Three patient samples containing both EpCAM$^+$ tumour cells and FAP$^+$ fibroblasts were expanded ex vivo, and the mixed (adherent) cell populations were cultured with PBMC-derived T-cells and unmodified or Bispecific T cell activator expressing EnAd viruses. After 72 h, total cells were harvested and the number of FAP$^+$ (FIG. 38, panel A) and EpCAM$^+$ cells (FIG. 38, panel B) determined by flow cytometry. Additionally, the activation status of T-cells (by CD25 expression) was measured (FIG. 38, panel C). Infection with both EnAd-CMV-FAP Bispecific T cell activator and EnAd-SA-FAP Bispecific T cell activator induced T-cell activation and FAP$^+$ cell depletion in all patient samples, with no significant change in levels of EpCAM+ tumour cells. Parental EnAd or the control viruses induced no observable T cell activation, with FAP+ cell numbers remaining similar to the uninfected control.

Importantly, this depletion in FAP+ fibroblasts consistently led to a strong reduction in levels of the immunosuppressive cytokine TGFβ detected in supernatants (FIG. 38, panel D).

In a second series of experiments, total (and unpurified) cells from five patient biopsy samples were evaluated to assess the activity of endogenous tumour-associated T-cells in the samples. Cells were plated in 50% ascites fluid and treated with recombinant control or FAP Bispecific T cell activator proteins, or 100 vp/cell of EnAd or EnAd-Bispecific T cell activator viruses. After 5 days incubation, T-cell activation (by CD25 expression) and residual number of FAP+ cells was measured by flow cytometry (FIGS. 39, panels A&B). In all 3 patient samples, recombinant FAP-Bispecific T cell activator and EnAd-CMV-FAP Bispecific T cell activator induced strong T-cell activation, with up to ~80% of patient-derived T-cells activated, which caused a marked depletion FAP+ fibroblasts. Interestingly, EnAd-SA-FAP-Bispecific T cell activator induced CD25 expression in 2/3 samples, with no observable activation or FAP+ cell depletion in patient 1. This is probably due to insufficient tumour cells being present for infection by the virus and production of Bispecific T cell activator protein (no EpCAM+ tumour cells were detected in this sample by flow cytometry), consistent with the requirement for tumour cells for MLP (SA)-driven transgene expression (this likely also explains the lack of T-cell activation and FAP+ cell depletion by EnAd-SA-FAP-Bispecific T cell activator virus with the patient ascites sample illustrated in FIGS. 42-44). Collectively, the data shows that EnAd expressing FAP-Bispecific T cell activator can, following infection of tumor cells, reproducibly lead to activation of tumour-associated T-cells to kill endogenous fibroblasts.

Another experiment investigated whether FAP-Bispecific T cell activator activity could be improved by blocking the PD-1 checkpoint, using a patient biopsy sample in which T-cells were 73.6% PD-1 positive and FAP+ cells were 62.9% PDL1-positive (FIG. 40, panel A). Co-cultures similar to those described above were set up in the presence or absence of a purified blocking mouse IgG2b antibody to human PDL1 (BioLegend, clone 29E.2A3) at a final concentration of 2.5 µg/mL. After 2 days of culture, total cells were harvested and residual FAP+ cells and T-cell activation was measured. The inclusion of the blocking anti-PDL1 antibody led to a modest increase in CD25 induction (FIG. 40, panel B) and a two-fold higher IFNγ production (FIG. 40, panel C), without altering the depletion of FAP+ cells (FIG. 40, panel D) with near complete lysis by day 2 in either setting.

Tumour-associated lymphocytes (TALs) isolated from ovarian cancer patient ascites are reported to have enriched expression of PD-1 and impaired effector functions—including cytotoxicity and IFNg production. Consistent with this, PD-1 expression was 2-fold higher on CD3+ cells from six cancer patient ascites biopsies than on those in peripheral blood mononuclear cells (PBMCs) from three healthy donors (FIG. 41, panel A). To evaluate the functionality of the T-cells within these cancer biopsy samples, NHDF cells and unpurified PBMC or ascites cells (the % CD3+ cells for each of the samples is shown in FIG. 41, panel B) were co-cultured with control or FAP Bispecific T cell activator-containing supernatants, and supernatants were harvested 5 days later and tested for IFNγ by ELISA (FIG. 41, panel C). No IFNγ was induced by the control Bispecific T cell activator. Three of the ascites cell samples produced IFNγ at a similar level to that of the PBMC samples, while the other three had an attenuated response to the FAP Bispecific T cell activator. We next investigate the ability of these T-cells to induce Bispecific T cell activator-mediated lysis of the NHDF cells. NHDF were plated, and PBMC or ascites cells added along with Bispecific T cell activator-containing supernatants and the viability of cells in the culture monitored in real-time using the xCELLigence cytotoxicity assay system. Despite the variability in IFNγ production, all ascites samples induced full cytotoxicity of NHDF cells when added with the FAP Bispecific T cell activator, with an overall similar rate of Bispecific T cell activator-mediated NHDF lysis to that seen with when effected by PBMCs (FIG. 41, panel D).

To investigate whether the FAP Bispecific T cell activator can mediate T-cell activation in the presence patient malignant exudate samples (all at 50%), PBMC T-cells were activated with control or FAP Bispecific T cell activators in the presence of NHDF cells, or activated with anti-CD3/CD28 Dynabeads, either in 50% normal human serum (NS) or different (cell-free) malignant exudate samples. Whereas in normal serum 74% of T-cells were activated (dual-positive for both CD25 and CD69) at 24 h following stimulation with the anti-CD3/CD28 beads, 3/5 tested ascites fluid significantly attenuated T-cell activation compared to the response in NS (FIG. 42, panel A). However, when PBMCs were cultured with NHDF and stimulated with the FAP Bispecific T cell activator, there was no observable suppression of T-cell activation in the presence of any of the exudate fluids (FIG. 42, panel B), demonstrating that the FAP Bispecific T cell activator can overcome immunosuppressive mechanisms to activate T-cells.

Example 19

EnAd-FAP Bispecific T Cell Activator-Mediated Oncolysis and T Cell Stimulation Polarise CD11b+ TAMs in Patient Ascites to a More Activated Phenotype To investigate whether the production of Th1 cytokines, including IFNγ, TNFα and IL-2, by FAP Bispecific T cell activator-mediated activation of T-cells, and the subsequent elimination of FAP+ fibroblasts (and associated reduction in TGFβ1 was associated other shifts in the tumour microenvironment from immunosuppressive and pro-oncogenic towards anti-tumour activity, the effect on tumour-associated macrophages (TAMs) in an unseparated ascites cell sample was evaluated. Total unpurified patient ascites cells were plated in 50% ascites fluid and treated with free control or FAP Bispecific T cell activator or infected with EnAd-SA-control Bispecific T cell activator or EnAd-SA-FAP Bispecific T cell activator virus (at 100 vp/cell). In parallel, some cells were treated in with IFNγ to induce an activated CD11b myeloid cell phenotype. After 3 days incubation, the activation status of T-cells was first measured; CD25+ cells measured by flow cytometry and IFNγ secretion by ELISA.

Treatment with FAP Bispecific T cell activator and EnAd-SA-FAP Bispecific T cell activator led to approximately 60% of CD3+ T-cells becoming CD25+ (FIG. 43 panel A) and large quantities of IFNγ in culture supernatants (FIG. 43, panel B). No increase above background by the control Bispecific T cell activator or control virus was observed for CD25 expression or IFNγ. To evaluate TAM polarisation, the expression levels of CD64 and CD86 (M1 or 'activated' macrophage markers) and CD206 and CD163 (M2 or TAM markers) were measured on CD11b+ cells by flow cytometry (FIG. 43, panel C). Treatment with free FAP Bispecific T cell activator or EnAd expressing FAP Bispecific T cell activator induce a more activated phenotype, manifested by significant increases in CD64 expression, and strong decreases CD206 and CD163—similar to that observed when IFNγ was spiked into the cultures.

While treatment with free FAP Bispecific T cell activator or control virus induced no clear change in CD86 above background in this experiment, the EnAd expressing FAP Bispecific T cell activator induced a large increase in CD86 expression, indicating that EnAd virus infection and FAP Bispecific T cell activator activity may synergize to activate primary myeloid cells within a suppressive tumour microenvironment such as the malignant ascetic fluid samples tested here. In this study, IFNγ treatment induced a modest decrease in CD86, indicating that the strong increase in CD86 observed by EnAd-SA-FAP Bispecific T cell activator may be via an IFNγ-independent mechanism.

Example 20

EnAd-FAP Bispecific T Cell Activator Activates Tumour-Infiltrating Lymphocytes and Induces Cytotoxicity in Solid Prostate Tumour Biopsies Ex Vivo Tissue slice cultures provide one of the most realistic preclinical models of diverse tissues, organs and tumours. To evaluate the activity of the FAP Bispecific T cell activator expressing viruses in this highly clinically-relevant setting, several paired punch biopsies of malignant and benign prostate tissue from resected human prostates were studies. At initial screening, prostate tissue was reproducibly shown to have circular rings of EpCAM+ tumour cells (FIG. 44, panel A) interspersed between large regions of stroma containing scattered CD8 T-cells (FIG. 44, panel B). FAP staining was found on fibroblasts adjacent to tumour regions (FIG. 44, panel C).

Cores were sliced by a vibratome to 300 µm thickness and slice cultures established in the presence of virus (1.5e9 vp/slice), or left uninfected. After 7 days, slices were fixed, paraffin-embedded, sectioned and T-cell activation status was assessed by immunohistochemistry (IHC) by staining for CD25 expression (FIG. 44, panel D). Only samples receiving EnAd-CMV-FAP Bispecific T cell activator or EnAd-SA-FAP Bispecific T cell activator showed activation of tumour-infiltrating T-cells, manifest by strong CD25 staining. Neither untreated or control virus-treated had detectable CD25-positive cells. Supernatants from these slice cultures taken at 4 and 7 days post-infection were tested for IFNγ and IL-2 by ELISA, with increases in IFNγ detected from malignant, but not benign, prostate slice cultures infected with either FAP Bispecific T cell activator virus (FIG. 44, panel E) and IL-2 detected in cultures with EnAd-SA-FAP Bispecific T cell activator virus (FIG. 44, panel F). The EnAd-SA-FAP Bispecific T cell activator induced higher quantities of IFNγ, which were detectable earlier, than the CMV-driven FAP Bispecific T cell activator virus.

Example 21—Further EnAd Viruses Expressing FAP Bispecific T Cell Activators

Five viruses (NG-611, NG-612, NG-613, NG-614, NG-617) were generated that encode a single Bispecific T cell activator (Table 8).

TABLE 8

| Virus ID | Transgene Cassette |
| --- | --- |
| NG-612 (SEQ ID NO: 78 | SSA[1]-FAP Bispecific T cell activator[5]-His[3]-PA[4] |
| NG-613 (SEQ ID NO: 79) | SA[6]-FAP Bispecific T cell activator[5]-His[3]-PA[4] |
| NG-614 (SEQ ID NO: 73) | SA[6]-FAP Bispecific T cell activator[7]-His[3]-PA[4] |
| NG-617 (SEQ ID NO: 81) | SSA[1]-FAP Bispecific T cell activator[5]-PA[4] |

In each transgene cassette, the cDNA encoding the Bispecific T cell activator was flanked at the 5' end with either a short splice acceptor sequence (SSA, CAGG) or a longer splice acceptor sequence (SA, SEQUENCE ID NO: 45). At the 3' end of the Bispecific T cell activator, a SV40 late poly(A) sequence (PA, SEQUENCE ID NO: 54) was encoded preceded by either a Histidine tag (HIS) or no tag. In viruses NG-611, NG-612, NG-613 and NG-617 the anti-CD3 portion of the Bispecific T cell activator molecule used a single chain variant of the mouse anti-human CD3ε monoclonal antibody OKT3.

Virus Production

The plasmid pEnAd2.4 was used to generate the plasmids pNG-611, pNG-612, pNG-613, pNG-614 and pNG-617 by direct insertion of synthesised transgene cassettes (SEQ ID NOs: 70-74, respectively). The pNG-612, pNG-613 and pNG-617 transgene cassettes encode a FAP targeting Bispecific T cell activator of SEQ ID NO. 75 and the pNG-614 transgene cassette encodes a FAP targeting Bispecific T cell activator of SEQ ID NO. 76. A schematic of the transgene cassette is shown in FIG. 45. Construction of plasmid DNA was confirmed by restriction analysis and DNA sequencing.

The plasmids, pNG-611, pNG-612, pNG-613, pNG-614 and pNG-617, were linearised by restriction digest with the enzyme AscI to produce the virus genomes. The viruses were amplified and purified according to methods given below.

Digested DNA was purified by phenol/chloroform extraction and precipitated for 16 hrs, −20° C. in 300 µl >95% molecular biology grade ethanol and 10 µl 3M Sodium Acetate. The precipitated DNA was pelleted by centrifuging at 14000 rpm, 5 mins and was washed in 500 µl 70% ethanol, before centrifuging again, 14000 rpm, 5 mins. The clean DNA pellet was air dried, resuspended in 500 µl OptiMEM containing 15 µl lipofectamine transfection reagent and incubated for 30 mins, RT. The transfection mixture was then added drop wise to a T-25 flask containing 293 cells grown to 70% confluency. After incubation of the cells with the transfection mix for 2 hrs at 37° C., 5% $CO_2$ 4 mls of cell media (DMEM high glucose with glutamine supplemented with 2% FBS) was added to the cells and the flasks was incubated 37° C., 5% $CO_2$.

The transfected 293 cells were monitored every 24 hrs and were supplemented with additional media every 48-72 hrs. The production of virus was monitored by observation of a significant cytopathic effect (CPE) in the cell monolayer. Once extensive CPE was observed the virus was harvested from 293 cells by three freeze-thaw cycles. The harvested viruses were used to re-infect 293 cells in order to amplify the virus stocks. Viable virus production during amplification was confirmed by observation of significant CPE in the cell monolayer. Once CPE was observed the virus was harvested from 293 cells by three freeze-thaw cycles. The amplified stocks of viruses were used for further amplification before the viruses were purified by double caesium chloride banding to produce purified virus stocks.

Virus Activity Assessed by qPCR

A549 cells, either infected for 72 hrs with 1 ppc NG-611, NG-612, NG-617, enadenotucirev or left uninfected, were used for quantification of viral DNA by qPCR. Cell supernatants were collected and clarified by centrifuging for 5 mins, 1200 rpm. DNA was extracted from 45 μL of supernatant using the Qiagen DNeasy kit, according to the manufacturer's protocol. A standard curve using enadenotucirev virus particles (2.5e10-2.5e5vp) was also prepared and extracted using the DNeasy kit Each extracted sample or standard was analysed by qPCR using a virus gene specific primer-probe set to the early gene E3.

Quantification of the number of detected virus genomes per cell demonstrated that NG-611, NG-612, and NG-617 showed significant genome replication in A549 cell lines (FIG. 46). This was similar for all viruses tested including the parental virus enadenotucirev, indicating that inclusion of the Bispecific T cell activator transgene does not impact virus replicative activity. No virus genomes could be detected in uninfected cells (data not shown).

T Cell Activation and Degranulation Mediated by Bispecific T Cell Activator Expressing Viruses.

Carcinoma Cell Infection

A549 cells were seeded into 24 well plates at a density of 2.5e5 cells/well. Plates were incubated for 4 hrs, 37° C., 5% $CO_2$, before cells were either infected with 1 ppc of NG-611, NG-612, enadenotucirev or were left uninfected. At 24, 48 or 72 hrs post-infection supernatants were harvested from the cells, clarified by centrifuging for 5 mins, 1200 rpm and snap frozen.

T Cell Assay

FAP expressing lung fibroblast cell lines MRC-5, or EpCam expressing ovarian carcinoma cells, SKOV3 were seeded into 48 well plates at densities of 5.7e4 cells/well and 1.2e5 cells/well, respectively. Plates were incubated for 4 hrs, 37° C., 5% $CO_2$, before media was replaced with 150 μL/well of thawed supernatant harvested from the A549 plates. Purified CD3 T cells isolated form human PBMC donors were then also added to the plates to give a ratio of T cells to MRC-5 or SKOV3 of 2 to 1. The co-cultures were incubated for 16 hrs, 37° C., 5% $CO_2$ before cellular supernatants were collected for ELISA analysis and T cells harvested for flow cytometry analysis. Culture media containing non-adherent cells was removed from co-culture wells and centrifuged (300×g). The supernatant was carefully removed, diluted 1 in 2 with PBS 5% BSA and stored for ELISA analysis. The adherent cell monolayers were washed once with PBS and then detached using trypsin. The trypsin was inactivated using 10% FBS RPMI media and the cells were added to the cell pellets that had been collected from the culture supernatants. The cells were centrifuged (300×g), the supernatant discarded and the cell pellet washed in 200 μL of PBS. The cells were centrifuged again then resuspended in 50 μL of PBS containing Live/Dead Aqua (Life tech) for 15 minutes at RT. The cells were washed once in FACs buffer before staining with panels of directly conjugated antibodies: anti-CD3 conjugated to AF700; anti-CD25 conjugated to BV421; anti-HLA-DR conjugated to PE/CYS; anti-CD40L conjugated to BV605; anti-CD69 conjugated to PE and anti-CD107a conjugated to FITC. A sample of cells from each co-culture condition was also stained with relevant isotype control antibodies. All staining was carried out in FACs buffer in a total volume of 50 μL/well for 15 minutes, 4° C. Cells were then washed twice with FACs buffer (200 μL) before resuspension in 200 μL of FACs buffer and analysis by Flow cytometry (Attune).

Upregulation of T Cell Activation Markers

Flow cytometry analysis of T cell activation was assessed by expression of the T cell activation markers CD25, CD69, HLA-DR and CD40L or the T cell degranulation marker, CD107a on live, single cells. These data showed that when co-cultured with EpCam+ SKOV3 cells the number of T cells expressing CD25, CD69, HLA-DR, CD40L or cell surface CD107a was significantly increased when NG-611 supernatants were added to the cells compared to NG-612, enadenotucirev or untreated control supernatants (FIG. 47). For all these markers little T cell activation was stimulated by supernatants from A549 cells infected for 24 hrs however, by 48 hrs post-infection, supernatants stimulated significant T cell activation across all markers. This was also the case at 72 hrs post-infection.

When co-cultured with FAP+ MRC-5 cells the number of T cells expressing CD25, CD69, HLA-DR, CD40L or cell surface CD107a was significantly increased when NG-612 supernatants were added to the cells compared to NG-611, enadenotucirev or untreated control supernatants (FIG. 48). Some T cell activation could also be observed with the NG-611 virus, which was likely due to low but detectable expression of EpCam (~5%) on the MRC-5 cell lines engaging the EpCam Bispecific T cell activator expressed by the NG-611 virus (FIG. 49). For all these markers, little T cell activation was stimulated by supernatants from A549 cells infected for 24 hrs however, by 48 hrs post-infection, supernatants stimulated significant T cell activation across all markers. CD25 and CD69 markers were also upregulated following incubation with supernatants harvested 72 hrs post-infection, however, activation markers, HLA-DR, CD40L and CD107a were detected at lower levels with supernatants harvested 72 hrs post-infection than 48 hrs post-infection. This could be due to high levels of Bispecific T cell activator present at this later stage of infection leading to rapid and potent T cell activation that means the effector functions need to measured at timepoints earlier than 16 hrs post-incubation with the supernatants.

For detection of IFNγ expression, co-culture supernatants were diluted into 5% BSA/PBS assay buffer (in a range of 1:10 to 1:1000) and ELISA was carried out using the Human IFN gamma Quantikine ELISA kit (R&D systems) according to the manufacturer's protocol. The concentration of secreted IFNγ was determined by interpolating from the standard curve. Expression of IFNγ could only be detected in the supernatants of co-cultures using NG-611 on SKOV3 cells FIG. 50A) or NG-611, NG-612 on MRC-5 cells (FIG. 50B).

Example 22 Immune Activation and Anti-Tumour Efficacy of Bispecific T Cell Activator Expressing Viruses In Vivo NSG mice humanised CD34+ haematopoietic stem cells (from Jackson Labs) were implanted with HCT116 tumour cells subcutaneously on both flanks at 18 weeks post engraftment. Once tumours reached 80-400 $mm^3$ mice were grouped such that each treatment arm had an equivalent distribution of tumour volumes, 7 mice per group. Mice were injected intratumourally with either saline, enadenotucirev or NG-611 at 5×10$^9$ particles per injection, 2 injections per tumour. Tumours on both flanks were treated. Tumour volume was measured 3-4 times per week and demonstrated that NG-611 treatment resulted in a significant anti-tumour response out to 20 days post-dosing compared to enadenotucirev or untreated controls (FIG. 51, panel a). After the 20 days post-dosing one tumour from 4 mice in each group was processed for flow cytometry while remaining tumours were frozen on dry ice.

Flow Cytometry

Tumour samples were mechanically disaggregated immediately following resection in a small volume of RPMI media. Disaggregated tumours were then passed through a 70 µm cell strainer and centrifuged at 300 g for 10 minutes. Cell pellets were resuspended in 100 µL of PBS containing Live/Dead Aqua (Life tech) for 15 minutes on ice. The cells were washed once in FACs buffer (5% BSA PBS) before staining with a panel of directly conjugated antibodies: anti-CD8 (RPA-T8, AF700); anti-CD4 (RPA-T4, PE); anti-CD45 (2D1, APC-Fire 750); anti-CD3 (OKT3, PerCP-Cy5.5); anti-CD25 (M-A251, PE-Dazzle 594); anti-CD69 (FN50, APC); anti-HLA-DR (L243, BV605); anti-CD107a (H4A3, FITC). A pool of tumour cell suspensions was also stained with relevant isotype control antibodies. All staining was carried out in FACs buffer in a total volume of 50 µL/well for 20 minutes at 4° C. Cells were washed three times with FACs buffer (200 µL) before resuspension in 200 µL of FACs buffer and analysis by Flow cytometry (Attune). FACs analysis demonstrated that the ratio of CD8 to CD4 T cells in the tumour was significantly increased in NG-611 treated tumours compared to enadenotucirev treated or untreated controls (FIG. 51, panel b).

Example 23—EnAd Viruses Co-Expressing FAP Bispecific T Cell Activators and Immune-Modulatory Cytokines and Chemokines Three viruses (NG-615, NG-640 and NG-641) were generated that encoded a FAP Bispecific T cell activator and immunomodulatory proteins (Table 9).

Virus Activity Assessed by qPCR and Transgene ELISA

Carcinoma Cell Infection

A549 cells either infected for 72 hrs with 1 ppc NG-615, enadenotucirev or left uninfected were used for quantification of viral DNA by qPCR and analysis of transgene expression by ELISA. Cell supernatants were collected and clarified by centrifuging for 5 mins, 1200 rpm. 45 µL of supernatant was used for DNA analysis and the remaining supernatant was used for ELISA.

qPCR

DNA was extracted from the supernatant sample using the Qiagen DNeasy kit, according to the manufacturer's protocol. A standard curve using enadenotucirev virus particles (2.5e10-2.5e5vp) was also prepared and extracted using the DNeasy kit. Each extracted sample or standard was analysed by qPCR using a virus gene specific primer-probe set to the early gene E3. Quantification of the number of detected virus genomes per cell demonstrated that NG-615 showed significant genome replication in A549 cell lines at a level similar to that of the parental virus enadenotucirev (FIG. 52). These data indicated that inclusion of the Bispecific T cell activator and three immunomodulatory transgenes does not significantly impact virus replicative activity. No virus genomes could be detected in uninfected cells.

ELISA

IFNα ELISA was carried out using the Verikine Human IFN alpha Kit (Pbl assay science), MIP1α ELISA was carried out using the Human CCL3 Quantikine ELISA kit (R & D systems) and Flt3L ELISA was carried out using the Flt3L human ELISA kit (Abcam). All assays were carried out according to the manufacturers' protocol.

The concentrations of secreted IFNα, MIPα or FLt3L were determined by interpolating from the standard curves.

TABLE 9

| Virus ID | Transgene Cassette |
| --- | --- |
| NG-615 (SEQ ID NO: 82) | $SSA^1$-FAP Bispecific T cell activator$^2$-$E2A^3$-$Flt3L^4$-$P2A^5$-$MIP1\alpha^6$-$T2A^7$-$IFN\alpha^8$-$PA^9$ |
| NG-640 (SEQ ID NO: 83) | $SSA^1$-FAP Bispecific T cell activator$^2$-$P2A^5$-$CXCL10^{10}$-$T2A^7$-$CXCL9^{11}$-$PA^6$ |
| NG-641 (SEQ ID NO: 84) | $SSA^1$-FAP Bispecific T cell activator$^5$-$P2A^5$-$CXCL10^{10}$-$T2A^7$-$CXCL9^{11}$-$E2A^3$-$IFN\alpha^8$-$PA^6$ |
| NG-615 (SEQ ID NO: 278) | $SA^{12}$-FAP Bispecific T cell activator$^2$-$E2A^3$-$Flt3L^4$-$P2A^5$-$MIP1\alpha^6$-$T2A^7$-$IFN\alpha^8$-$PA^9$ |

Virus Production

The plasmid pEnAd2.4 was used to generate the plasmids pNG-615, pNG-616, pNG-640 and pNG-641 by direct insertion of synthesised transgene cassettes (SEQ ID NOs: 93-95, respectively). NG-615 and NG-616 contain four transgenes encoding for a FAP-targeting Bispecific T cell activator (SEQ ID NO: 75), Flt3L (SEQ ID NO. 96), MIP1α SEQ ID NO. 97) and IFNα (SEQ ID NO. 98). NG-640 and NG-641 encode for a FAP targeting Bispecific T cell activator (SEQ ID NO. 75), CXCL9 (SEQ ID NO. 99) and CXCL10 (SEQ ID NO. 100), NG-641 also contains a fourth transgene encoding IFNα (SEQ ID NO. 98). Construction of plasmid DNA was confirmed by restriction analysis and DNA sequencing.

The plasmids, pNG-615, pNG-616, pNG-640 and pNG-641, were linearised by restriction digest with the enzyme AscI to produce the virus genomes. The viruses were amplified and purified according to methods detailed in Example 33.

IFNα, MIP1α and Flt3 L expression could be detected in the cellular supernatant of NG-615 but not enadenotucirev or untreated control cells (FIG. 53).

T Cell Activation and Degranulation Mediated by Bispecific T Cell Activator Expressing Viruses.

Carcinoma Cell Infection

A549 cells were seeded into 24 well plates at a density of 2.5e5 cells/well. Plates were incubated for 4 hrs, 37° C., 5% $CO_2$, before cells were either infected with 1 ppc of NG-612, NG-615, enadenotucirev or were left uninfected. At 24, 48 or 72 hrs post-infection supernatants were harvested from the cells, clarified by centrifuging for 5 mins, 1200 rpm and snap frozen.

T Cell Assay

FAP expressing lung fibroblast cell lines MRC-5 were seeded into 48 well plates at a density of 5.7e4 cells/well. Plates were incubated for 4 hrs, 37° C., 5% $CO_2$, before media was replaced with 150 µL/well of thawed supernatant harvested from the A549 plates. Purified CD3 T cells isolated form human PBMC donors were then also added to the plates to give a ratio of T cells to MRC-5 of 2 to 1. The co-cultures were incubated for 16 hrs, 37° C., 5% $CO_2$ before cellular supernatants were collected for ELISA analysis and T cells harvested for flow cytometry analysis according to the methods detailed in Example 29.

Upregulation of T Cell Activation Markers

Flow cytometry analysis of T cell activation was assessed by expression of the T cell activation markers CD25, CD69, HLA-DR and CD40L or the T cell degranulation marker, CD107a on live, $CD3^+$, single cells. These data showed that when co-cultured with $FAP^+$ MRC-5 cells the number of T cells expressing CD25, CD69, HLA-DR, CD40L or CD107a was significantly increased when NG-615 or 612 supernatants were added to the cells compared to enadenotucirev or untreated control supernatants (FIG. 54).

Secretion of the Stimulatory Cytokine IFNγ

For detection of IFNγ expression, co-culture supernatants were diluted into 5% BSA/PBS assay buffer (in a range of 1:10 to 1:1000) and ELISA was carried out using the Human IFN gamma Quantikine kit (RandD Systems) according to the manufacturer's protocol. The concentration of secreted IFNγ was determined by interpolating from the standard curve. Expression of IFNγ could only be detected in the supernatants of co-cultures using NG-612 or NG-615 infected A549 supernatants (FIG. 55).

SEQ ID NO: 95
Transgene cassette for NG-641
CAGGCCCACCATGGGCTGGAGCTGCATCATCTTGTTCCTGGTCGCAACTG

CTACCGGAGTCCATTCGGACATCGTCATGACCCAAAGCCCTGACTCGCTC

GCTGTGTCACTGGGAGAGCGGGCGACTATCAACTGCAAATCATCCCAGAG

CCTGCTGTATTCACGCAATCAGAAAAACTACCTGGCCTGGTATCAGCAGA

AGCCGGGCCAGCCTCCCAAGCTGCTGATCTTCTGGGCCTCCACCCGCGAA

AGCGGCGTGCCGGACCGCTTCAGCGGAAGCGGATTCGGAACTGACTTTAC

TCTGACCATTAGCTCCTTGCAGGCGGAGGACGTGGCCGTCTACTACTGCC

AGCAGTATTTCTCCTATCCGCTCACCTTTGGGCAAGGCACCAAGGTGGAG

ATTAAGGGAGGGGCGGCAGCGGGGGAGGCGGCAGCGGCGGCGGGGGATC

GCAGGTCCAGCTCGTCCAATCCGGAGCCGAAGTCAAGAAGCCGGGAGCGT

CGGTCAAGGTCAGCTGCAAAACTTCGCGCTACACCTTCACTGAGTACACG

ATCCACTGGGTCCGCCAGGCGCCCGGCCAGCGGCTGGAGTGGATCGGCGG

GATCAACCCAAACAACGGAATCCCAAATTACAATCAGAAATTTAAAGGGC

GGGTGACTATCACCGTGGATACCTCGGCCTCCACGGCGTACATGGAGCTC

TCATCACTCAGATCGGAGGACACCGCGGTCTATTACTGCGCCCGCCGCCG

GATCGCTTATGGATACGATGAAGGACATGCGATGGATTACTGGGGCCAGG

GCACCCTCGTCACGGTGTCGTCAGGAGGCGGCGGTTCACAGGTGCAGCTG

CAGCAGTCTGGGGCTGAACTGGCAAGACCTGGGGCCTCAGTGAAGATGTC

CTGCAAGGCTTCTGGCTACACCTTTACTAGGTACACGATGCACTGGGTAA

AACAGAGGCCTGGACAGGGTCTGGAATGGATTGGATACATTAATCCTAGC

CGTGGTTATACTAATTACAATCAGAAGTTCAAGGACAAGGCCACATTGAC

TACAGACAAATCCTCCAGCACAGCCTACATGCAACTGAGCAGCCTGACAT

CTGAGGACTCTGCAGTCTATTACTGTGCAAGATATTATGATGATCATTAC

TGCCTTGACTACTGGGGCCAAGGCACCACTCTCACAGTCTCCTCAGGTGG

CGGTGGCTCGGGCGGTGGTGGATCTGGTGGCGGCGGATCTGATATCGTGC

TCACTCAGTCTCCAGCAATCATGTCTGCATCTCCAGGGGAGAAGGTCACC

ATGACCTGCAGTGCCAGCTCAAGTGTAAGTTACATGAACTGGTACCAGCA

GAAGTCAGGCACCTCCCCCAAAAGATGGATTTATGACACATCCAAACTGG

CTTCTGGAGTCCCTGCTCACTTCAGGGGCAGTGGGTCTGGGACCTCTTAC

TCTCTCACAATCAGCGGCATGGAGGCTGAAGATGCTGCCACTTATTACTG

CCAGCAGTGGAGTAGTAACCCATTCACGTTCGGCTCGGGGACAAAGTTGG

AAATAAACCGGGGAAGCGGAGCTACTAACTTCAGCCTGCTGAAGCAGGCT

GGAGACGTGGAGGAGAACCCTGGACCTAATCAAACTGCCATTCTGATTTG

CTGCCTTATCTTTCTGACTCTAAGTGGCATTCAAGGAGTACCTCTCTCTA

GAACTGTACGCTGTACCTGCATCAGCATTAGTAATCAACCTGTTAATCCA

AGGTCTTTAGAAAAACTTGAAATTATTCCTGCAAGCCAATTTTGTCCACG

TGTTGAGATCATTGCTACAATGAAAAAGAAGGGTGAGAAGAGATGTCTGA

ATCCAGAATCGAAGGCCATCAAGAATTTACTGAAAGCAGTTAGCAAGGAA

AGGTCTAAAAGATCTCCTGGAAGCGGAGAGGGCAGAGGAAGTCTGCTAAC

ATGCGGTGACGTCGAGGAGAATCCTGGACCTAAGAAAAGTGGTGTTCTTT

TCCTCTTGGGCATCATCTTGCTGGTTCTGATTGGAGTGCAAGGAACCCCA

GTAGTGAGAAAGGGTCGCTGTTCCTGCATCAGCACCAACCAAGGGACTAT

CCACCTACAATCCTTGAAAGACCTTAAACAATTTGCCCCAAGCCCTTCCT

GCGAGAAAATTGAAATCATTGCTACACTGAAGAATGGAGTTCAAACATGT

CTAAACCCAGATTCAGCAGATGTGAAGGAACTGATTAAAAAGTGGGAGAA

ACAGGTCAGCCAAAAGAAAAAGCAAAAGAATGGGAAAAAACATCAAAAAA

AGAAAGTTCTGAAAGTTCGAAAATCTCAACGTTCTCGTCAAAAGAAGACT

ACAGGAAGCGGACAGTGTACTAATTATGCTCTCTTGAAATTGGCTGGAGA

TGTTGAGAGCAACCCTGGACCTGCCTTGACCTTTGCTTTACTGGTGGCCC

TCCTGGTGCTCAGCTGCAAGTCAAGCTGCTCTGTGGGCTGTGATCTGCCT

CAAACCCACAGCCTGGGTAGCAGGAGGACCTTGATGCTCCTGGCACAGAT

GAGGAGAATCTCTCTTTTCTCCTGCTTGAAGGACAGACATGACTTTGGAT

TTCCCCAGGAGGAGTTTGGCAACCAGTTCCAAAAGGCTGAAACCATCCCT

GTCCTCCATGAGATGATCCAGCAGATCTTCAATCTCTTCAGCACAAAGGA

CTCATCTGCTGCTTGGGATGAGACCCTCCTAGACAAATTCTACACTGAAC

TCTACCAGCAGCTGAATGACCTGGAAGCCTGTGTGATACAGGGGGTGGGG

GTGACAGAGACTCCCCTGATGAAGGAGGACTCCATTCTGGCTGTGAGGAA

ATACTTCCAAAGAATCACTCTCTATCTGAAAGAGAAGAAATACAGCCCTT

GTGCCTGGGAGGTTGTCAGAGCAGAAATCATGAGATCTTTTTCTTTGTCA

ACAAACTTGCAAGAAAGTTTAAGAAGTAAGGAATAAGCTAGCTTGACTGA

CTGAGATACAGCGTACCTTCAGCTCACAGACATGATAAGATACATTGATG

AGTTTGGACAAACCACAACTAGAATGCAGTGAAAAAAATGCTTTATTTGT

GAAATTTGTGATGCTATTGCTTTATTTGTAACCATTATAAGCTGCAATAA

ACAAGTTAACAACAACAATTGCATTCATTTTATGTTTCAGGTTCAGGGGG

-continued

```
AGGTGTGGGAGGTTTTTTAAAGCAAGTAAAACCTCTACAAATGTGGTAGT

CGTCAGCTAT
```

SEQUENCE LISTING (281 sequences)

SEQ ID NO: 1 - DNA, 1551 bp, Artificial Sequence
  FAP-bispecific T cell activator nucleic acid sequence
atgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccgg

SEQ ID NO: 2 - protein, 517 aa, Artificial Sequence
  FAP-bispecific T cell activator amino acid sequence
MGWSCIILFLVATATGVHSDIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIKGGGGSGGGGSGGGGSQVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 3 - DNA, 1629 bp, Artificial Sequence
  Control (Anti-FHA) bispecific T cell activator DNA coding sequence, with N-terminal signal sequence and C-terminal deca-His affinity tag
atgggttggtcatgcatcatcctgtttctcgtcgcaactgcgaccggcgtgcattcggaactggacatcgtgatgacccaggcacctgcatcactggcagtgagcctgggacagagagccaccatttcatgccgggccagcaagagcgtgtcgtcatccggatacaattatctgcactggtatcagcagaaaccaggacaacctccaaagctactcatctacctggcgtcgaacctcgaatcgggcgtcccagctagattctcagggagcggttcgggaaccgatttcaccctgaacatccaccctgtggaggaggaagacgcggcaacgtactattgccagcattcccgcgagttccctctcactttcggtgcgggaactaagctggagatcaagtccagcggcggcggaggtagcggtggaggtggcggaggaagctcccggtcgtcgctggaggtgcagctgcaacaatccggcccggaactggtcaagccaggcgcatccgtcaagatttcatgcaagacctcggggtacaccttcaccgggtacacgatgcattgggtcaggcagagccacggcaagtccctggaatggatcggaggaatcaaccccaaaaacggcggcatcatctacaaccaaaagttccagggaaaagccactctgaccgtggacaagtcgtcgagcacggccagcatggagctgcggtccctcacttccgacgactcagccgtgtattactgcgcgagacgggtctacgatgactacccatactactacgctatggactactggggacaaggaaccagcgtgaccgtctcatcggcgaaaactactccgccgtcggtgacgtcgggaggtggtggaagcgacgtgcagctcgtccagtcgggtgccgaggtgaagaagccaggagcctccgtgaaggtctcgtgcaaagccagcggctacacttttactaggtacactatgcactgggtgcggcaagcgccgggacaaggtctggagtggatcggatacatcaatccgtcgcggggatacactaattacgcggactccgtcaagggacggtttactatcactacggataagtccactagcaccgcctacatggaactgtcctcgctgcggtcggaagacactgcgacctactactgcgctagatattacgatgaccactactgcctcgactattgggggcagggcactacggtcaccgtctcgtcgggagaaggaacctcaactggatcgggcggatcgggaggctccggaggagccgacgacatcgtgcttacccagtcgcctgcgaccctgtccctgtccccaggagagagagcgactctttcatgcagggcttcccaatcagtctcctacatgaattggtatcaacaaaaacccggcaaggccccgaaacgctggatctacgatacttcaaaggtggccagcggtgtgcctgcccgcttctccgggtcggggtccggcaccgattactcgttgactatcaatagcctggaggccgaggacgctgcaacttactactgccagcagtggtcctccaaccctctcaccttcggaggcgggaccaaggtggaaatcaaacatcaccatcaccatcaccaccatcaccattag

SEQ ID NO: 4 - protein, 542 aa, Artificial Sequence
  Control (Anti-FHA) bispecific T cell activator amino acid sequence with N-terminal signal sequence and C-terminal deca-His affinity tag
MGWSCIILFLVATATGVHSELDIVMTQAPASLAVSLGQRATISCRASKSVSSSGYNYLHWYQQKPGQPPKLLIYLASNLESGVPARFSGSGSGTDFTLNIHPVEEEDAATYYCQHSREFPLTFGAGTKLEIKSSGGGGSGGGGGGSSRSSLEVQLQQSGPELVKPGASVKISCKTSGYTFTGYTMHWVRQSHGKSLEWIGGINPKNGGIIYNQKFQGKATLTVDKSSSTASMELRSLTSDDSAVYYCARRVYDDYPYYYAMDYWGQGTSVTVSSAKTTPPSVTSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKHHHHHHHHHH

SEQ ID NO: 5 - protein, 243 aa, Artificial Sequence
  SEQ ID NO: 7
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 6 - protein, 119 aa, Artificial Sequence
  Anti-CD3 VH
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 7 - protein, 106 aa, Artificial Sequence
  Anti-CD3 VL
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 8 - protein, 18 aa, Artificial Sequence
  Anti-CD3 ScFv linker sequence
GEGTSTGSGGSGGSGGAD

SEQ ID NO: 9 - protein, 252 aa, Artificial Sequence
  Anti-FAP ScFv
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIKGGGGSGGGGSGGGGSQVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSS

SEQ ID NO: 10 - protein, 113 aa, Artificial Sequence
  Anti-FAP VL domain
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIK

SEQ ID NO: 11 - protein, 124 aa, Artificial Sequence
  Anti-FAP VH domain
QVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSS

SEQ ID NO: 12 - protein, 15 aa, Artificial Sequence
  Anti-FAP and Anti-EpCAM linker sequence
GGGGSGGGGSGGGGS

SEQ ID NO: 13 - protein, 19 aa, Artificial Sequence
  bispecific T cell activator leader sequence
MGWSCIILFLVATATGVHS

SEQ ID NO: 14 - protein, 542 aa, Artificial Sequence; identical to SEQ ID NO: 4
  Control bispecific T cell activator (Anti-FHA)

SEQ ID NO: 15 - protein, 265 aa, Artificial Sequence
  Control (Anti-FHA) ScFv
ELDIVMTQAPASLAVSLGQRATISCRASKSVSSSGYNYLHWYQQKPGQPPKLLIYLASNLESGVPARFSGSGSGTDFTLNIHPVEEEDAATYYCQHSREFPLTFGAGTKLEIKSSGGGGSGGGGGGSSRSSLEVQLQQSGPELVKPGASVKISCKTSGYTFTGYTMHWVRQSHGKSLEWIGGINPKNGGIIYNQKFQGKATLTVDKSSSTASMELRSLTSDDSAVYYCARRVYDDYPYYYAMDYWGQGTSVTVSSAKTTPPSVTS

SEQ ID NO: 16 - protein, 113 aa, Artificial Sequence
  Control (Anti-FHA) VL
ELDIVMTQAPASLAVSLGQRATISCRASKSVSSSGYNYLHWYQQKPGQPPKLLIYLASNLESGVPARFSGSGSGTDFTLNIHPVEEEDAATYYCQHSREFPLTFGAGTKLEIK

SEQ ID NO: 17 - protein, 133 aa, Artificial Sequence
  Control (Anti-FHA) VH
EVQLQQSGPELVKPGASVKISCKTSGYTFTGYTMHWVRQSHGKSLEWIGGINPKNGGIIYNQKFQGKATLTVDKSSSTASMELRSLTSDDSAVYYCARRVYDDYPYYYAMDYWGQGTSVTVSSAKTTPPSVTS

SEQ ID NO: 18 - protein, 19 aa, Artificial Sequence
  Control (Anti-FHA) ScFv linker sequence
SSGGGGSGGGGGGSSRSSL

SEQ ID NO: 19 - protein, 10 aa, Artificial Sequence
  Deca-His Tag sequence
HHHHHHHHHH

SEQ ID NO: 20 - protein, 786 aa, Artificial Sequence
  FAP bispecific T cell activator-P2A-RFP
MGWSCIILFLVATATGVHSDIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIKGGGGSGGGGSGGGGSQVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKHHHHHHHHHHRRKRGSGATNFSLLKQAGDVEENPGPMSELIKENMHMKLYMEGTVNNHHFKCTSEGEGKPYEGTQTMKIKVVEGGPLPFAFDILATSFMYGSKAFINHTQGIPDFFKQSFPEGFTWERITTYEDGGVLTATQDTSFQNGCIIYNVKINGVNFPSNGPVMQKKTRGWEANTEMLYPADGGLRGHSQMALKLVGGGYLHCSFKTTYRSKKPAKNLKMPGFHFVDHRLERIKEADKETYVEQHEMAVAKYCDLPSKLGHR

SEQ ID NO: 21 - protein, 799 aa, Artificial Sequence
  Control (Anti-FHA) bispecific T cell activator-P2A-RFP
MGWSCIILFLVATATGVHSELDIVMTQAPASLAVSLGQRATISCRASKSVSSSGYNYLHWYQQKPGQPPKLLIYLASNLESGVPARFSGSGSGTDFTLNIHPVEEEDAATYYCQHSREFPLTFGAGTKLEIKSSGGGGSGGGGGGSSRSSLEVQLQQSGPELVKPGASVKISCKTSGYTFTGYTMHWVRQSHGKSLEWIGGINPKNGGIIYNQKFQGKATLTVDKSSSTASMELRSLTSDDSAVYYCARRVYDDYPYYYAMDYWGQGTSVTVSSAKTTPPSVTSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKHHHHHHHHHHRRKRGSGATNFSLLKQAGDVEENPGPMSELIKENMHMKLYMEGTVNNHHFKCTSEGEGKPYEGTQTMKIKVVEGGPLPFAFDILATSFMYGSKAFINHTQGIPDFFKQSFPEGFTWERITTYEDGGVLTATQDTSFQNGCIIYNVKINGVNFPSNGPVMQKKTRGWEANTEMLYPADGGLRGHSQMALKLVGGGYLHCSFKTTYRSKKPAKNLKMPGFHFVDHRLERIKEADKETYVEQHEMAVAKYCDLPSKLGHR

SEQ ID NO: 22 - DNA, 2283 bp, Artificial Sequence
  Human FAP DNA coding sequence
atgaagacctgggtgaaaatcgtgtttggagtcgcaaccagcgccgtgctggccctgttggtgatgtgcatcgtgctgcgcccgtcacgcgtgcataacagcgaagaaaacaccatgagagctctgacgctaaaggacatcctgaatggcactttttcctataagactttcttcccgaattggattagcgggcaggagtacctgcaccaatcggcggataacaatatcgtgctctacaacatcgaaactggccagagctacaccatcctgtcgaatagaactatgaaatcggtgaatgcgtcgaactacggacttagcccggaccgccagttcgtgtacctagaatcggactacagcaagctgtggcggtacagctacactgctacgtactacatctacgacctgtcgaatggcgagttcgtgagaggaaacgaactcccccgcccgatccaatacctgtgctggagccctgtgggaagcaagctggcgtacgtgtatcagaacaacatctacctcaagcagaggccgggcgacccacctttccagatcacttttaacggtcgggagaacaagattttcaatggaatcccggattgggtgtacgaagaagagatgctggcgaccaaatatgcgctctggtggtcgccaaacggaaaatttctagcatacgccgagttcaatgacaccgacatccccgtcatcgcctacagctactacggagatgagcaatacccacgcactattaatatcccgtacccgaaagccggcgctaaaaatccggtcgtgcggatcttcatcatcgacactacctatccagcttacgtgggaccgcaagaggtccctgtgccagccatgatcgccagcagcgattactacttctcctggctgacttgggtcactgacgagagggtgtgcctccaatggctcaagcgcgtgcagaacgtgagcgtgctgtccatctgcgacttcagagaagattggcaaacgtgggactgtccgaaaactcaagagcatatcgaggagagcagaaccggatgggcaggggggttcttcgtgtccaccccggtgttcagctacgatgcgatctcgtactacaagattttctccgataaggacgggtacaaacatatccactacatcaaggacaccgtggagaatgcgatccaaatcactagcggaaaatgggaagcgattaacattttccgggtgacgcaagactcattgttctattcatccaatgaatttgaagagtaccctggccggaggaacatctaccgcatctccatcggatcatacccaccatcaaagaagtgcgtgacctgccatctccgcaaggagcgctgccaatactacaccgcgtccttctccgattacgcgaagtactacgccctggtgtgctacggcccgggaatcccaatctcgaccctacatgatgggcgcaccgaccaggagatcaaaatcctggaggaaaacaaggagctcgaaaatgctctgaaaaatattcaactaccgaaggaggaaatcaagaagctggaggtggatgaaattactctgtggtacaaaatgatcctgccgccacagttcgaccgctccaagaagtacccgctgctgatccaggtgtacggaggaccctgctcacagtcggtgcgctcagtgtttgctgtgaattggatcagctacctcgcatcaaaggaggggatggtcatcgcgcttgtggacggaagaggtactgcattccagggggacaaactgctctacgcggtgtaccgcaagctgggcgtctacgaggtggaggaccaaatcacggcggtcagaaagttcatcgagatgggtttcatcgacgagaagaggatcgccatctggggctggtcgtacggaggttacgtgtcgtcactcgctctggcgagcgggactggattgttcaaatgcggtatcgcagtcgcccccgtgtcgtcatgggaatactacgcctcggtgtataccgaacgctttatgggactccctactaaagacgataacctagagcactacaaaaactcgacggtgatggcacgcgcagagtactttcgcaatgtggattacctcctgatccacggaaccgccgatgataatgtccacttccagaactcagcccaaatcgcgaaagccctggtgaacgctcaagtggactttcaagcaatgtggtattcagaccagaaccacggactatccggcctatcgactaatcacctgtacacccatatgacccatttccttaaacagtgtttcagcctgtccgattag

SEQ ID NO: 23 - protein, 760 aa, Artificial Sequence
  Human FAP amino acid sequence
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 24 - DNA, 571 bp, Artificial Sequence
  CMV promoter sequence
agtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccg

SEQ ID NO: 25 - DNA, 192 bp, Artificial Sequence
  SV40 late polyadenylation sequence
cagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggtttttt

SEQ ID NO: 26 - DNA, 34895 bp, Artificial Sequence
  NG-605 (EnAd-CMV-FAP bispecific T cell activator)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 27 - DNA, 34216 bp, Artificial Sequence
  NG-606 (EnAd-SA-FAP bispecific T cell activator)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 28 - DNA, 32326 bp, Artificial Sequence
  EnAd genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 29 - DNA, 200 bp, Artificial Sequence
  B chi DNA sequence corresponding to and including bp 28166-28366 of the EnAd genome
aaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccag

SEQ ID NO: 30 - DNA, 35 bp, Artificial Sequence
  B gamma DNA sequence corresponding to and including bp 29345-29379 of the EnAd genome
caaataaagtttaacttgtttatttgaaaatcaat

SEQ ID NO: 31 - protein, 6 aa, Artificial Sequence
  His Tag
HHHHHH

SEQ ID NO: 32 - DNA, 14 bp, Artificial Sequence
  Splice acceptor
tttctctcttcagg

SEQ ID NO: 33 - DNA, 192 bp, Artificial Sequence; identical to SEQ ID NO: 25
  SV40 poly Adenylation sequence

SEQ ID NO: 34 - DNA, 1551 bp, Artificial Sequence; identical to SEQ ID NO: 1
  FAP bispecific T cell activator nucleic acid sequence (OKT3)

SEQ ID NO: 35 - DNA, 1557 bp, Artificial Sequence
  FAP bispecific T cell activator nucleic acid sequence (aCD3)
atgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaag

SEQ ID NO: 36 - DNA, 1856 bp, Artificial Sequence
  NG-611 Transgene cassette
caggcccaccatgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 37 - DNA, 1868 bp, Artificial Sequence
  NG-612 Transgene cassette
caggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 38 - DNA, 1878 bp, Artificial Sequence
  NG-613 Transgene cassette
tttctctcttcaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 39 - DNA, 19 bp, Artificial Sequence
  Restriction site insert (B chi)
gcggccgctatggccggcc

SEQ ID NO: 40 - DNA, 19 bp, Artificial Sequence
  Restriction site insert (B gamma)
gcgatcgctaccctgcagg

SEQ ID NO: 41 - DNA, 572 bp, Artificial Sequence
  CMV promoter sequence
agtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgt

SEQ ID NO: 42 - DNA, 505 bp, Artificial Sequence
  PGK promoter sequence
ctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctacccctcccctagtcaggaagttcccccccgccccgcagctcgcgtcatgcaggacgtgacaaatggaagtagcacgtctcactagtctcgtgcaaatggacagcaccgctgagcaatggaagcgggtaggcccttggggcagcggccaatagcagctttgctccttcgctttctgggctcagaggctgggaaggggtgggtccgggggcgggctcaggggcgggctcaggggcggggcgggcgcccgaaggtcctccggaggcccggcattccgcacgcttcaaaagcgcacgtctgccgcgctgttctcttcttcctcatctccgggcctttcg

SEQ ID NO: 43 - DNA, 367 bp, Artificial Sequence
  CBA promoter sequence
gtcgaggtgagccccacgttctgcttcactctccccatctcccccccctccccacccccaattttgtatttatttattttttaattattttatgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacag

SEQ ID NO: 44 - skipped

SEQ ID NO: 45 - DNA, 16 bp, Artificial Sequence
  splice acceptor (SA) DNA sequence
cctttctctcttcagg

SEQ ID NO: 46 - DNA, 23 bp, Artificial Sequence
  branched splice acceptor (bSA) DNA sequence
tgctaatcctttctctcttcagg

SEQ ID NO: 47 - skipped

SEQ ID NO: 48 - RNA, 13 nt, Artificial Sequence
  Example of start codon
  misc_feature (11)..(11): R is adenine or guanine
gccgccrccaugg

SEQ ID NO: 49 - DNA, 551 bp, Artificial Sequence
  Internal Ribosome Entry Sequence (IRES)
cgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataata

SEQ ID NO: 50 - protein, 22 aa, Artificial Sequence
  P2A peptide
GSGATNFSLLKQAGDVEENPGP

SEQ ID NO: 51 - protein, 21 aa, Artificial Sequence
  F2A peptide
GSGEGRGSLLTCGDVEENPGP

SEQ ID NO: 52 - protein, 23 aa, Artificial Sequence
  E2A peptide
GSGQCTNYALLKLAGDVESNPGP

SEQ ID NO: 53 - protein, 25 aa, Artificial Sequence
  T2A peptide
GSGVKQTLNFDLLKLAGDVESNPGP

SEQ ID NO: 54 - DNA, 192 bp, Artificial Sequence; identical to SEQ ID NO: 25
  Polyadenylation (polyA) sequence

SEQ ID NO: 55 - protein, 19 aa, Artificial Sequence
  Leader sequence
MGWSCIILFLVATATGVHS

SEQ ID NO: 56 - protein, 19 aa, Artificial Sequence
  Leader sequence
MDWTWRVFCLLAVAPGAHS

SEQ ID NO: 57 - protein, 166 aa, Artificial Sequence
  IFN gamma amino acid sequence
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 58 - protein, 188 aa, Artificial Sequence
  IFN alpha amino acid sequence
MALTFALLVALLVLSCKSSCSVGCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 59 - protein, 233 aa, Artificial Sequence
  TNF alpha amino acid sequence
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 60 - DNA, 5288 bp, Artificial Sequence
  DNA sequence corresponding to E2B region of the EnAd genome (bp 10355-5068)
ctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcat

SEQ ID NO: 61 - DNA, 1560 bp, Artificial Sequence
  Anti-FAP bispecific T cell activator DNA coding sequence, with N-terminal signal sequence without C-terminal deca-His affinity tag
atgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagtag

SEQ ID NO: 62 - protein, 519 aa, Artificial Sequence
  Anti-FAP bispecific T cell activator amino acid sequence, with N-terminal signal sequence without C-terminal deca-His affinity tag
MGWSCIILFLVATATGVHSDIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIKGGGGSGGGGSGGGGSQVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 63 - DNA, 1599 bp, Artificial Sequence
  Control (Anti-FHA) bispecific T cell activator DNA coding sequence, with N-terminal signal sequence without C-terminal deca-His affinity tag
atgggttggtcatgcatcatcctgtttctcgtcgcaactgcgaccggcgtgcattcggaactggacatcgtgatgacccaggcacctgcatcactggcagtgagcctgggacagagagccaccatttcatgccgggccagcaagagcgtgtcgtcatccggatacaattatctgcactggtatcagcagaaaccaggacaacctccaaagctactcatctacctggcgtcgaacctcgaatcgggcgtcccagctagattctcagggagcggttcgggaaccgatttcaccctgaacatccaccctgtggaggaggaagacgcggcaacgtactattgccagcattcccgcgagttccctctcactttcggtgcgggaactaagctggagatcaagtccagcggcggcggaggtagcggtggaggtggcggaggaagctcccggtcgtcgctggaggtgcagctgcaacaatccggcccggaactggtcaagccaggcgcatccgtcaagatttcatgcaagacctcggggtacaccttcaccgggtacacgatgcattgggtcaggcagagccacggcaagtccctggaatggatcggaggaatcaaccccaaaaacggcggcatcatctacaaccaaaagttccagggaaaagccactctgaccgtggacaagtcgtcgagcacggccagcatggagctgcggtccctcacttccgacgactcagccgtgtattactgcgcgagacgggtctacgatgactacccatactactacgctatggactactggggacaaggaaccagcgtgaccgtctcatcggcgaaaactactccgccgtcggtgacgtcgggaggtggtggaagcgacgtgcagctcgtccagtcgggtgccgaggtgaagaagccaggagcctccgtgaaggtctcgtgcaaagccagcggctacacttttactaggtacactatgcactgggtgcggcaagcgccgggacaaggtctggagtggatcggatacatcaatccgtcgcggggatacactaattacgcggactccgtcaagggacggtttactatcactacggataagtccactagcaccgcctacatggaactgtcctcgctgcggtcggaagacactgcgacctactactgcgctagatattacgatgaccactactgcctcgactattgggggcagggcactacggtcaccgtctcgtcgggagaaggaacctcaactggatcgggcggatcgggaggctccggaggagccgacgacatcgtgcttacccagtcgcctgcgaccctgtccctgtccccaggagagagagcgactctttcatgcagggcttcccaatcagtctcctacatgaattggtatcaacaaaaacccggcaaggccccgaaacgctggatctacgatacttcaaaggtggccagcggtgtgcctgcccgcttctccgggtcggggtccggcaccgattactcgttgactatcaatagcctggaggccgaggacgctgcaacttactactgccagcagtggtcctccaaccctctcaccttcggaggcgggaccaaggtggaaatcaaatag

SEQ ID NO: 64 - protein, 532 aa, Artificial Sequence
  Control (Anti-FHA) bispecific T cell activator amino acid sequence with N-terminal signal sequence without C-terminal deca-His tag
MGWSCIILFLVATATGVHSELDIVMTQAPASLAVSLGQRATISCRASKSVSSSGYNYLHWYQQKPGQPPKLLIYLASNLESGVPARFSGSGSGTDFTLNIHPVEEEDAATYYCQHSREFPLTFGAGTKLEIKSSGGGGSGGGGGGSSRSSLEVQLQQSGPELVKPGASVKISCKTSGYTFTGYTMHWVRQSHGKSLEWIGGINPKNGGIIYNQKFQGKATLTVDKSSSTASMELRSLTSDDSAVYYCARRVYDDYPYYYAMDYWGQGTSVTVSSAKTTPPSVTSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 65 - protein, 532 aa, Artificial Sequence; identical to SEQ ID NO: 64
  Control bispecific T cell activator (Anti-FHA) without C-terminal deca-His tag

SEQ ID NO: 66 - DNA, 34865 bp, Artificial Sequence
  NG-605 (EnAd-CMV-FAP bispecific T cell activator) without deca-His tag
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 67 - DNA, 34186 bp, Artificial Sequence
  NG-606 (EnAd-SA-FAP bispecific T cell activator) without deca-His tag
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 68 - DNA, 1551 bp, Artificial Sequence; identical to SEQ ID NO: 1
  FAP bispecific T cell activator nucleic acid sequence (OKT3)

SEQ ID NO: 69 - DNA, 1557 bp, Artificial Sequence; identical to SEQ ID NO: 35
  FAP bispecific T cell activator nucleic acid sequence (aCD3)

SEQ ID NO: 70 - DNA, 1856 bp, Artificial Sequence; identical to SEQ ID NO: 36
  NG-611 Transgene cassette

SEQ ID NO: 71 - DNA, 1868 bp, Artificial Sequence; identical to SEQ ID NO: 37
  NG-612 Transgene cassette

SEQ ID NO: 72 - DNA, 1878 bp, Artificial Sequence; identical to SEQ ID NO: 38
  NG-613 Transgene cassette

SEQ ID NO: 73 - DNA, 1884 bp, Artificial Sequence
  NG-614 Transgene cassette
tttctctcttcaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 74 - DNA, 1838 bp, Artificial Sequence
  NG-617 Transgene cassette
caggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 75 - protein, 517 aa, Artificial Sequence; identical to SEQ ID NO: 2
  FAP bispecific T cell activator amino acid sequence (OKT3)

SEQ ID NO: 76 - protein, 519 aa, Artificial Sequence; identical to SEQ ID NO: 62
  FAP bispecific T cell activator amino acid sequence (aCD3)

SEQ ID NO: 77 - DNA, 34198 bp, Artificial Sequence
  NG-611 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 78 - DNA, 34210 bp, Artificial Sequence
  NG-612 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 79 - DNA, 34220 bp, Artificial Sequence
  NG-613 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctttctctcttcaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 80 - DNA, 34226 bp, Artificial Sequence
  NG-614 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctttctctcttcaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 81 - DNA, 34180 bp, Artificial Sequence
  NG-617 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 82 - DNA, 35749 bp, Artificial Sequence
  NG-615 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggacagtgtactaattatgctctcttgaaattggctggagatgttgagagcaaccctggacctacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccgggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 83 - DNA, 34972 bp, Artificial Sequence
  NG-640 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggagctactaacttcagcctgctgaagcaggctggagacgtggaggagaaccctggacctaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcctggaagcggagagggcagaggaagtctgctaacatgcggtgacgtcgaggagaatcctggacctaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 84 - DNA, 35602 bp, Artificial Sequence
  NG-641 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggagctactaacttcagcctgctgaagcaggctggagacgtggaggagaaccctggacctaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcctggaagcggagagggcagaggaagtctgctaacatgcggtgacgtcgaggagaatcctggacctaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacaggaagcggacagtgtactaattatgctctcttgaaattggctggagatgttgagagcaaccctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 85 - skipped

SEQ ID NO: 86 - DNA, 537 bp, Artificial Sequence
  FLT3 Ligand nucleic acid sequence
atgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccg

SEQ ID NO: 87 - skipped

SEQ ID NO: 88 - DNA, 279 bp, Artificial Sequence
  MIP1 alpha nucleic acid sequence
atgcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgcc

SEQ ID NO: 89 - protein, 18 aa, Artificial Sequence
  Flexible linker sequence
SPQYPSPLTLTLPPHPSL

SEQ ID NO: 90 - DNA, 564 bp, Artificial Sequence
  IFN alpha nucleic acid sequence
atggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 91 - DNA, 294 bp, Artificial Sequence
  CXCL10 nucleic acid sequence
atgaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcct

SEQ ID NO: 92 - DNA, 372 bp, Artificial Sequence
  CXCL9 nucleic acid sequence
aagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactaca

SEQ ID NO: 93 - DNA, 3407 bp, Artificial Sequence
  NG-615 Transgene Cassette
caggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggacagtgtactaattatgctctcttgaaattggctggagatgttgagagcaaccctggacctacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccgggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 94 - DNA, 2630 bp, Artificial Sequence
  NG-640 Transgene Cassette
caggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggagctactaacttcagcctgctgaagcaggctggagacgtggaggagaaccctggacctaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcctggaagcggagagggcagaggaagtctgctaacatgcggtgacgtcgaggagaatcctggacctaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 95 - DNA, 3260 bp, Artificial Sequence
  NG-641 Transgene Cassette
caggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggagctactaacttcagcctgctgaagcaggctggagacgtggaggagaaccctggacctaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcctggaagcggagagggcagaggaagtctgctaacatgcggtgacgtcgaggagaatcctggacctaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacaggaagcggacagtgtactaattatgctctcttgaaattggctggagatgttgagagcaaccctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 96 - protein, 154 aa, Artificial Sequence
  FLT3 Ligand amino acid sequence
MTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAP

SEQ ID NO: 97 - protein, 93 aa, Artificial Sequence
  MIP1 alpha amino acid sequence
MQVSTAALAVLLCTMALCNQVLSAPLAADTPTACCFSYTSRQIPQNFIADYFETSSQCSKPSVIFLTKRGRQVCADPSEEWVQKYVSDLELSA

SEQ ID NO: 98 - protein, 188 aa, Artificial Sequence; identical to SEQ ID NO: 58
  IFN alpha amino acid sequence

SEQ ID NO: 99 - protein, 125 aa, Artificial Sequence
  CXCL9 amino acid sequence
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 100 - protein, 98 aa, Artificial Sequence
  CXCL10 amino acid sequence
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 101 - DNA, 35788 bp, Artificial Sequence
  NG-618 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggttggagctgtattattctcttcctcgtcgccaccgcgaccggagtgcattccgagctcgtgatgacccagtcaccatcatccttgaccgtgactgcgggcgagaaggtcacgatgtcatgcaagtcgtcacaaagcctgctgaactccggcaatcagaagaattacctgacctggtaccagcagaaaccgggtcagccgccaaaactgctgatctactgggcatccacccgggaaagcggggtccctgaccggttcactggatcaggatcaggaaccgactttaccctcacgatctcaagcgtccaagccgaggacttggctgtgtactactgccaaaatgactactcgtaccccctgactttcggagctgggaccaagctggagatcaaaggcggcggagggtccggaggaggggggtcgggaggggggggaagcgaggtgcagctgctggaacagagcggagccgagctggtgagaccaggcaccagcgtgaaaatctcgtgcaaggcctcggggtacgctttcacgaactactggttgggttgggtgaagcagcggccgggtcatggactggagtggatcggagacatctttcccggaagcggaaatatccattacaacgaaaagtttaaaggcaaggccacccttactgcggataagtcaagctccaccgcttacatgcaactgtcctcactgacttttgaagacagcgctgtgtatttctgcgctcgcctgcgcaattgggatgaacctatggactactggggccaaggaaccaccgtgactgtgtcgtcgggagggggaggctcacaagtgcagctgcagcagtcaggtgcagaattggccaggccgggagccagcgtgaagatgtcgtgcaaagcctccggctacaccttcactcgctacactatgcattgggtgaaacagcggccgggacaagggctggagtggatcggatacatcaatccatcaagaggttacaccaactacaatcagaagttcaaggacaaggctaccctgacgactgataagagctcgtcaactgcatacatgcagctgtcgagcctgaccagcgaggattccgccgtgtactactgcgcgagatactatgatgaccactactgcttggattactggggccaagggaccactctgaccgtgtcctccggcggagggggctcgggcggcgggggctcggggggcggcggcagcgacatcgtgctgacgcagagccccgcaatcatgtcagcctcccctggcgaaaaagtgacgatgacctgctccgcttcctcatcagtctcctacatgaactggtatcaacagaagagcggaacctcgccgaagcgctggatctacgatacctccaaactggccagcggagtgccggcgcattttcggggatcgggcagcggtacctcctactcgctcaccatctcaggaatggaagccgaagacgccgccacctactactgccagcagtggtcctcaaacccattcaccttcggatccggcactaagctggaaatcaaccgcgggagcggagcgactaacttcagcttgctcaagcaagccggagatgtcgaggagaacccgggacctggttggtcgtgcatcatcctattccttgtcgcgaccgcaactggcgtccattccgacatcgtcatgacccaatccccagattcgctggcggtgtcgcttggggaacgggcaaccatcaactgcaagagctcgcagtcactgctatacagccggaatcagaaaaactacctggcgtggtaccagcaaaagccgggtcagcctccgaagctgctgattttctgggcctcaacccgggaatccggagtccctgacagattcagcgggtccggattcgggaccgacttcactctgactatttcgagcctgcaagcagaagatgtggcagtgtactattgccaacagtatttttcatacccgctgaccttcggccagggtacgaaggtggagatcaagggtggagggggtagcggcgggggaggcagcggcggggggggaagccaggtgcagctggtccaatcaggcgccgaggtcaagaaacctggagcgtcggtcaaggtctcctgcaagactagccgctacacttttaccgaatacaccatccactgggtcagacaggcgcccggtcagcgcctggagtggatcggcgggatcaacccgaataatggaatcccgaactacaatcaaaaattcaaaggccgcgtgactatcaccgtggatacttcagcctcaactgcttacatggaactgtcatcgctgagatcagaggacactgcggtctactactgtgcgcgcagaagaatcgcttacggatacgacgaggggcacgcaatggactactggggacagggaaccctggtgaccgtgtcgtcaggcggaggaggatcggatgtgcagttggtgcagtcgggcgccgaagtgaaaaaaccgggggcctcagtgaaagtgtcctgcaaggcctccggatacaccttcacccgctacactatgcactgggtcaggcaggcgcccgggcagggcctggagtggatcgggtatatcaacccgtcaaggggatacactaactacgccgactccgtgaagggaagattcactatcaccactgacaaatcaacttcgacggcgtatatggaactgtcatccttgagatcggaagataccgcgacctactactgtgcgcgctactacgatgaccattactgcctcgattactggggacagggcaccacggtgaccgtctcatcaggagaaggaacttcaactggttccggaggctccggcggctcaggcggcgctgacgacattgtgctgacccagagcccggcgaccctgtcactctcgccgggggaaagggctactctgtcatgcagagcgtcacaatcggtctcatacatgaactggtaccagcagaaaccgggcaaggctccaaagcggtggatctacgatacttcgaaggtggcttcaggagtgccggctcgcttcagcggatccggctcgggaaccgattacagcttgaccattaactcgctggaggcggaggatgcagcgacctactactgtcaacaatggtcctcgaacccactcacttttgggggcgggaccaaggtggagattaagtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 102 - DNA, 1557 bp, Artificial Sequence
  NG-618 FAP bispecific T cell activator nucleic acid sequence
atgggttggtcgtgcatcatcctattccttgtcgcgaccgcaactggcgtccattccgacatcgtcatgacccaatccccagattcgctggcggtgtcgcttggggaacgggcaaccatcaactgcaagagctcgcagtcactgctatacagccggaatcagaaaaactacctggcgtggtaccagcaaaagccgggtcagcctccgaagctgctgattttctgggcctcaacccgggaatccggagtccctgacagattcagcgggtccggattcgggaccgacttcactctgactatttcgagcctgcaagcagaagatgtggcagtgtactattgccaacagtatttttcatacccgctgaccttcggccagggtacgaaggtggagatcaagggtggagggggtagcggcgggggaggcagcggcggggggggaagccaggtgcagctggtccaatcaggcgccgaggtcaagaaacctggagcgtcggtcaaggtctcctgcaagactagccgctacacttttaccgaatacaccatccactgggtcagacaggcgcccggtcagcgcctggagtggatcggcgggatcaacccgaataatggaatcccgaactacaatcaaaaattcaaaggccgcgtgactatcaccgtggatacttcagcctcaactgcttacatggaactgtcatcgctgagatcagaggacactgcggtctactactgtgcgcgcagaagaatcgcttacggatacgacgaggggcacgcaatggactactggggacagggaaccctggtgaccgtgtcgtcaggcggaggaggatcggatgtgcagttggtgcagtcgggcgccgaagtgaaaaaaccgggggcctcagtgaaagtgtcctgcaaggcctccggatacaccttcacccgctacactatgcactgggtcaggcaggcgcccgggcagggcctggagtggatcgggtatatcaacccgtcaaggggatacactaactacgccgactccgtgaagggaagattcactatcaccactgacaaatcaacttcgacggcgtatatggaactgtcatccttgagatcggaagataccgcgacctactactgtgcgcgctactacgatgaccattactgcctcgattactggggacagggcaccacggtgaccgtctcatcaggagaaggaacttcaactggttccggaggctccggcggctcaggcggcgctgacgacattgtgctgacccagagcccggcgaccctgtcactctcgccgggggaaagggctactctgtcatgcagagcgtcacaatcggtctcatacatgaactggtaccagcagaaaccgggcaaggctccaaagcggtggatctacgatacttcgaaggtggcttcaggagtgccggctcgcttcagcggatccggctcgggaaccgattacagcttgaccattaactcgctggaggcggaggatgcagcgacctactactgtcaacaatggtcctcgaacccactcacttttgggggcgggaccaaggtggagattaag

SEQ ID NO: 103 - DNA, 3169 bp, Artificial Sequence
  NG-618 Transgene cassette
caggcccaccatgggttggagctgtattattctcttcctcgtcgccaccgcgaccggagtgcattccgagctcgtgatgacccagtcaccatcatccttgaccgtgactgcgggcgagaaggtcacgatgtcatgcaagtcgtcacaaagcctgctgaactccggcaatcagaagaattacctgacctggtaccagcagaaaccgggtcagccgccaaaactgctgatctactgggcatccacccgggaaagcggggtccctgaccggttcactggatcaggatcaggaaccgactttaccctcacgatctcaagcgtccaagccgaggacttggctgtgtactactgccaaaatgactactcgtaccccctgactttcggagctgggaccaagctggagatcaaaggcggcggagggtccggaggaggggggtcgggaggggggggaagcgaggtgcagctgctggaacagagcggagccgagctggtgagaccaggcaccagcgtgaaaatctcgtgcaaggcctcggggtacgctttcacgaactactggttgggttgggtgaagcagcggccgggtcatggactggagtggatcggagacatctttcccggaagcggaaatatccattacaacgaaaagtttaaaggcaaggccacccttactgcggataagtcaagctccaccgcttacatgcaactgtcctcactgacttttgaagacagcgctgtgtatttctgcgctcgcctgcgcaattgggatgaacctatggactactggggccaaggaaccaccgtgactgtgtcgtcgggagggggaggctcacaagtgcagctgcagcagtcaggtgcagaattggccaggccgggagccagcgtgaagatgtcgtgcaaagcctccggctacaccttcactcgctacactatgcattgggtgaaacagcggccgggacaagggctggagtggatcggatacatcaatccatcaagaggttacaccaactacaatcagaagttcaaggacaaggctaccctgacgactgataagagctcgtcaactgcatacatgcagctgtcgagcctgaccagcgaggattccgccgtgtactactgcgcgagatactatgatgaccactactgcttggattactggggccaagggaccactctgaccgtgtcctccggcggagggggctcgggcggcgggggctcggggggcggcggcagcgacatcgtgctgacgcagagccccgcaatcatgtcagcctcccctggcgaaaaagtgacgatgacctgctccgcttcctcatcagtctcctacatgaactggtatcaacagaagagcggaacctcgccgaagcgctggatctacgatacctccaaactggccagcggagtgccggcgcattttcggggatcgggcagcggtacctcctactcgctcaccatctcaggaatggaagccgaagacgccgccacctactactgccagcagtggtcctcaaacccattcaccttcggatccggcactaagctggaaatcaaccgcgggagcggagcgactaacttcagcttgctcaagcaagccggagatgtcgaggagaacccgggacctggttggtcgtgcatcatcctattccttgtcgcgaccgcaactggcgtccattccgacatcgtcatgacccaatccccagattcgctggcggtgtcgcttggggaacgggcaaccatcaactgcaagagctcgcagtcactgctatacagccggaatcagaaaaactacctggcgtggtaccagcaaaagccgggtcagcctccgaagctgctgattttctgggcctcaacccgggaatccggagtccctgacagattcagcgggtccggattcgggaccgacttcactctgactatttcgagcctgcaagcagaagatgtggcagtgtactattgccaacagtatttttcatacccgctgaccttcggccagggtacgaaggtggagatcaagggtggagggggtagcggcgggggaggcagcggcggggggggaagccaggtgcagctggtccaatcaggcgccgaggtcaagaaacctggagcgtcggtcaaggtctcctgcaagactagccgctacacttttaccgaatacaccatccactgggtcagacaggcgcccggtcagcgcctggagtggatcggcgggatcaacccgaataatggaatcccgaactacaatcaaaaattcaaaggccgcgtgactatcaccgtggatacttcagcctcaactgcttacatggaactgtcatcgctgagatcagaggacactgcggtctactactgtgcgcgcagaagaatcgcttacggatacgacgaggggcacgcaatggactactggggacagggaaccctggtgaccgtgtcgtcaggcggaggaggatcggatgtgcagttggtgcagtcgggcgccgaagtgaaaaaaccgggggcctcagtgaaagtgtcctgcaaggcctccggatacaccttcacccgctacactatgcactgggtcaggcaggcgcccgggcagggcctggagtggatcgggtatatcaacccgtcaaggggatacactaactacgccgactccgtgaagggaagattcactatcaccactgacaaatcaacttcgacggcgtatatggaactgtcatccttgagatcggaagataccgcgacctactactgtgcgcgctactacgatgaccattactgcctcgattactggggacagggcaccacggtgaccgtctcatcaggagaaggaacttcaactggttccggaggctccggcggctcaggcggcgctgacgacattgtgctgacccagagcccggcgaccctgtcactctcgccgggggaaagggctactctgtcatgcagagcgtcacaatcggtctcatacatgaactggtaccagcagaaaccgggcaaggctccaaagcggtggatctacgatacttcgaaggtggcttcaggagtgccggctcgcttcagcggatccggctcgggaaccgattacagcttgaccattaactcgctggaggcggaggatgcagcgacctactactgtcaacaatggtcctcgaacccactcacttttgggggcgggaccaaggtggagattaag

SEQ ID NO: 104 - protein, 7 aa, Artificial Sequence
  Flexible linker sequence
SGGGGSE

SEQ ID NO: 105 - protein, 6 aa, Artificial Sequence
  Flexible linker sequence
DKTHTS

SEQ ID NO: 106 - protein, 6 aa, Artificial Sequence
  Flexible linker sequence
  SITE (1)..(1): Ser is optional
SGGGGS

SEQ ID NO: 107 - protein, 11 aa, Artificial Sequence
  Flexible linker sequence
  SITE (1)..(1): Ser is optional
SGGGGSGGGGS

SEQ ID NO: 108 - protein, 16 aa, Artificial Sequence
  Flexible linker sequence
  SITE (1)..(1): Ser is optional
SGGGGSGGGGSGGGGS

SEQ ID NO: 109 - protein, 21 aa, Artificial Sequence
  Flexible linker sequence
  SITE (1)..(1): Ser is optional
SGGGGSGGGGSGGGGSGGGGS

SEQ ID NO: 110 - protein, 26 aa, Artificial Sequence
  Flexible linker sequence
  SITE (1)..(1): Ser is optional
SGGGGSGGGGSGGGGSGGGGSGGGGS

SEQ ID NO: 111 - protein, 11 aa, Artificial Sequence
  Flexible linker sequence
AAAGSGGASAS

SEQ ID NO: 112 - protein, 16 aa, Artificial Sequence
  Flexible linker sequence
  MISC_FEATURE (7)..(7): Xaa can be any naturally occurring amino acid
AAAGSGXGGGSGASAS

SEQ ID NO: 113 - protein, 21 aa, Artificial Sequence
  Flexible linker sequence
  MISC_FEATURE (7)..(7): Xaa can be any naturally occurring amino acid
  MISC_FEATURE (12)..(12): Xaa can be any naturally occurring amino acid
AAAGSGXGGGSXGGGSGASAS

SEQ ID NO: 114 - protein, 26 aa, Artificial Sequence
  Flexible linker sequence
  MISC_FEATURE (7)..(7): Xaa can be any naturally occurring amino acid
  MISC_FEATURE (12)..(12): Xaa can be any naturally occurring amino acid
  MISC_FEATURE (17)..(17): Xaa can be any naturally occurring amino acid
AAAGSGXGGGSXGGGSXGGGSGASAS

SEQ ID NO: 115 - protein, 31 aa, Artificial Sequence
  Flexible linker sequence
  MISC_FEATURE (7)..(7): Xaa can be any naturally occurring amino acid
  MISC_FEATURE (12)..(12): Xaa can be any naturally occurring amino acid
  MISC_FEATURE (17)..(17): Xaa can be any naturally occurring amino acid
  MISC_FEATURE (22)..(22): Xaa can be any naturally occurring amino acid
AAAGSGXGGGSXGGGSXGGGSXGGGSGASAS

SEQ ID NO: 116 - protein, 13 aa, Artificial Sequence
  Flexible linker sequence
  MISC_FEATURE (7)..(7): Xaa can be any naturally occurring amino acid
AAAGSGXSGASAS

SEQ ID NO: 117 - protein, 28 aa, Artificial Sequence
  Flexible linker sequence
PGGNRGTTTTRRPATTTGSSPGPTQSHY

SEQ ID NO: 118 - protein, 11 aa, Artificial Sequence
  Flexible linker sequence
ATTTGSSPGPT

SEQ ID NO: 119 - protein, 6 aa, Artificial Sequence
  Flexible linker sequence
ATTTGS

SEQ ID NO: 120 - protein, 18 aa, Artificial Sequence
  Flexible linker sequence
MPSLSGVLQVRYLSPPDL

SEQ ID NO: 121 - protein, 21 aa, Artificial Sequence
  Flexible linker sequence
EPSGPISTINSPPSKESHKSP

SEQ ID NO: 122 - protein, 15 aa, Artificial Sequence
  Flexible linker sequence
GTVAAPSVFIFPPSD

SEQ ID NO: 123 - protein, 15 aa, Artificial Sequence
  Flexible linker sequence
GGGGIAPSMVGGGGS

SEQ ID NO: 124 - protein, 15 aa, Artificial Sequence
  Flexible linker sequence
GGGGKVEGAGGGGGS

SEQ ID NO: 125 - protein, 15 aa, Artificial Sequence
  Flexible linker sequence
GGGGSMKSHDGGGGS

SEQ ID NO: 126 - protein, 15 aa, Artificial Sequence
  Flexible linker sequence
GGGGNLITIVGGGGS

SEQ ID NO: 127 - protein, 15 aa, Artificial Sequence
  Flexible linker sequence
GGGGVVPSLPGGGGS

SEQ ID NO: 128 - protein, 12 aa, Artificial Sequence
  Flexible linker sequence
GGEKSIPGGGGS

SEQ ID NO: 129 - protein, 18 aa, Artificial Sequence
  Flexible linker sequence
RPLSYRPPFPFGFPSVRP

SEQ ID NO: 130 - protein, 18 aa, Artificial Sequence
  Flexible linker sequence
YPRSIYIRRRHPSPSLTT

SEQ ID NO: 131 - protein, 18 aa, Artificial Sequence
  Flexible linker sequence
TPSHLSHILPSFGLPTFN

SEQ ID NO: 132 - protein, 18 aa, Artificial Sequence
  Flexible linker sequence
RPVSPFTFPRLSNSWLPA

SEQ ID NO: 133 - protein, 18 aa, Artificial Sequence
  Flexible linker sequence
SPAAHFPRSIPRPGPIRT

SEQ ID NO: 134 - protein, 18 aa, Artificial Sequence
  Flexible linker sequence
APGPSAPSHRSLPSRAFG

SEQ ID NO: 135 - protein, 18 aa, Artificial Sequence
  Flexible linker sequence
PRNSIHFLHPLLVAPLGA

SEQ ID NO: 136 - protein, 18 aa, Artificial Sequence
  Flexible linker sequence
NPSLNPPSYLHRAPSRIS

SEQ ID NO: 137 - protein, 17 aa, Artificial Sequence
  Flexible linker sequence
LPWRTSLLPSLPLRRRP

SEQ ID NO: 138 - protein, 18 aa, Artificial Sequence
  Flexible linker sequence
PPLFAKGPVGLLSRSFPP

SEQ ID NO: 139 - protein, 18 aa, Artificial Sequence
  Flexible linker sequence
VPPAPVVSLRSAHARPPY

SEQ ID NO: 140 - protein, 17 aa, Artificial Sequence
  Flexible linker sequence
LRPTPPRVRSYTCCPTP

SEQ ID NO: 141 - protein, 18 aa, Artificial Sequence
  Flexible linker sequence
PNVAHVLPLLTVPWDNLR

SEQ ID NO: 142 - protein, 18 aa, Artificial Sequence
  Flexible linker sequence
CNPLLPLCARSPAVRTFP

SEQ ID NO: 143 - protein, 11 aa, Artificial Sequence
  rigid linkers
GAPAPAAPAPA

SEQ ID NO: 144 - protein, 4 aa, Artificial Sequence
  rigid linkers
PPPP

SEQ ID NO: 145 - skipped

SEQ ID NO: 146 - protein, 8 aa, Artificial Sequence
  Linker sequence
  MISC_FEATURE (7)..(7): Xaa can be any naturally occurring amino acid
  MISC_FEATURE (8)..(8): Xaa can be any naturally occurring amino acid
DKTHTCXX

SEQ ID NO: 147 - protein, 11 aa, Artificial Sequence
  Linker sequence
DKTHTCPPCPA

SEQ ID NO: 148 - protein, 18 aa, Artificial Sequence
  Linker sequence
DKTHTCPPCPATCPPCPA

SEQ ID NO: 149 - protein, 25 aa, Artificial Sequence
  Linker sequence
DKTHTCPPCPATCPPCPATCPPCPA

SEQ ID NO: 150 - protein, 30 aa, Artificial Sequence
  Linker sequence
DKTHTCPPCPAGKPTLYNSLVMSDTAGTCY

SEQ ID NO: 151 - protein, 31 aa, Artificial Sequence
  Linker sequence
DKTHTCPPCPAGKPTHVNVSVVMAEVDGTCY

SEQ ID NO: 152 - protein, 15 aa, Artificial Sequence
  Linker sequences
DKTHTCCVECPPCPA

SEQ ID NO: 153 - protein, 26 aa, Artificial Sequence
  Linker sequence
DKTHTCPRCPEPKSCDTPPPCPRCPA

SEQ ID NO: 154 - protein, 11 aa, Artificial Sequence
  Linker sequence
DKTHTCPSCPA

SEQ ID NO: 155 - protein, 8 aa, Artificial Sequence
  Linker sequence
  MISC_FEATURE (7)..(7): Xaa can be any naturally occurring amino acid
  MISC_FEATURE (8)..(8): Xaa can be any naturally occurring amino acid
DKTHTSXX

SEQ ID NO: 156 - protein, 11 aa, Artificial Sequence
  Linker sequence
DKTHTCPPSPA

SEQ ID NO: 157 - protein, 11 aa, Artificial Sequence
  Linker sequence
DKTHTSPPCPA

SEQ ID NO: 158 - protein, 11 aa, Artificial Sequence
  Linker sequence
DKTHTSPPSPA

SEQ ID NO: 159 - protein, 18 aa, Artificial Sequence
  Linker sequence
DKTHTCPPCPATCPPSPA

SEQ ID NO: 160 - protein, 18 aa, Artificial Sequence
  Linker sequence
DKTHTCPPCPATSPPCPA

SEQ ID NO: 161 - protein, 18 aa, Artificial Sequence
  Linker sequence
DKTHTCPPSPATCPPCPA

SEQ ID NO: 162 - protein, 18 aa, Artificial Sequence
  Linker sequence
DKTHTSPPCPATCPPCPA

SEQ ID NO: 163 - protein, 18 aa, Artificial Sequence
  Linker sequence
DKTHTCPPCPATSPPSPA

SEQ ID NO: 164 - protein, 18 aa, Artificial Sequence
  Linker sequence
DKTHTCPPSPATCPPSPA

SEQ ID NO: 165 - protein, 18 aa, Artificial Sequence
  Linker sequence
DKTHTSPPCPATCPPSPA

SEQ ID NO: 166 - protein, 18 aa, Artificial Sequence
  Linker sequence
DKTHTSPPSPATCPPCPA

SEQ ID NO: 167 - protein, 18 aa, Artificial Sequence
  Linker sequence
DKTHTSPPCPATSPPCPA

SEQ ID NO: 168 - protein, 18 aa, Artificial Sequence
  Linker sequence
DKTHTCPPSPATSPPCPA

SEQ ID NO: 169 - protein, 18 aa, Artificial Sequence
  Linker sequence
DKTHTSPPSPATSPPSPA

SEQ ID NO: 170 - protein, 18 aa, Artificial Sequence
  Linker sequence
DKTHTCPPSPATSPPSPA

SEQ ID NO: 171 - protein, 18 aa, Artificial Sequence
  Linker sequence
DKTHTSPPCPATSPPSPA

SEQ ID NO: 172 - protein, 18 aa, Artificial Sequence
  Linker sequence
DKTHTSPPSPATCPPSPA

SEQ ID NO: 173 - protein, 18 aa, Artificial Sequence
  Linker sequence
DKTHTSPPSPATSPPCPA

SEQ ID NO: 174 - protein, 25 aa, Artificial Sequence
  Linker sequence
DKTHTCPPCPATCPPCPATCPPSPA

SEQ ID NO: 175 - protein, 25 aa, Artificial Sequence
  Linker sequence
DKTHTCPPCPATCPPCPATSPPCPA

SEQ ID NO: 176 - protein, 25 aa, Artificial Sequence
  Linker sequence
DKTHTCPPCPATCPPSPATCPPCPA

SEQ ID NO: 177 - protein, 25 aa, Artificial Sequence
  Linker sequence
DKTHTCPPCPATSPPCPATCPPCPA

SEQ ID NO: 178 - protein, 25 aa, Artificial Sequence
  Linker sequence
DKTHTCPPSPATCPPCPATCPPCPA

SEQ ID NO: 179 - protein, 25 aa, Artificial Sequence
  Linker sequence
DKTHTSPPCPATCPPCPATCPPCPA

SEQ ID NO: 180 - protein, 25 aa, Artificial Sequence
  Linker sequence
DKTHTCPPCPATCPPCPATSPPSPA

SEQ ID NO: 181 - protein, 25 aa, Artificial Sequence
  Linker sequence
DKTHTCPPCPATCPPSPATCPPSPA

SEQ ID NO: 182 - protein, 25 aa, Artificial Sequence
  Linker sequence
DKTHTCPPCPATSPPCPATCPPSPA

SEQ ID NO: 183 - protein, 25 aa, Artificial Sequence
  Linker sequence
DKTHTCPPSPATCPPCPATCPPSPA

SEQ ID NO: 184 - protein, 25 aa, Artificial Sequence
  Linker sequence
DKTHTSPPCPATCPPCPATCPPSPA

SEQ ID NO: 185 - protein, 25 aa, Artificial Sequence
  Linker sequence
DKTHTCPPCPATCPPSPATSPPCPA

SEQ ID NO: 186 - protein, 25 aa, Artificial Sequence
  Linker sequence
DKTHTCPPCPATSPPCPATSPPCPA

SEQ ID NO: 187 - protein, 25 aa, Artificial Sequence
  Linker sequence
DKTHTCPPSPATCPPCPATSPPCPA

SEQ ID NO: 188 - protein, 25 aa, Artificial Sequence
  Linker sequence
DKTHTSPPCPATCPPCPATSPPCPA

SEQ ID NO: 189 - protein, 25 aa, Artificial Sequence
  Linker sequence
DKTHTCPPCPATSPPSPATCPPCPA

SEQ ID NO: 190 - protein, 25 aa, Artificial Sequence
  Linker sequence
DKTHTCPPSPATCPPSPATCPPCPA

SEQ ID NO: 191 - protein, 25 aa, Artificial Sequence
  Linker sequence
DKTHTSPPCPATCPPSPATCPPCPA

SEQ ID NO: 192 - protein, 25 aa, Artificial Sequence
  Linker sequence
DKTHTCPPSPATSPPCPATCPPCPA

SEQ ID NO: 193 - protein, 25 aa, Artificial Sequence
  Linker sequence
DKTHTSPPCPATSPPCPATCPPCPA

SEQ ID NO: 194 - protein, 25 aa, Artificial Sequence
  Linker sequence
DKTHTSPPSPATCPPCPATCPPCPA

SEQ ID NO: 195 - protein, 25 aa, Artificial Sequence
  Linker sequence
DKTHTCPPCPATCPPSPATSPPSPA

SEQ ID NO: 196 - protein, 25 aa, Artificial Sequence
  Linker sequence
DKTHTCPPCPATSPPCPATSPPSPA

SEQ ID NO: 197 - protein, 25 aa, Artificial Sequence
  Linker sequence
DKTHTCPPSPATCPPCPATSPPSPA

SEQ ID NO: 198 - protein, 25 aa, Artificial Sequence
  Linker sequence
DKTHTSPPCPATCPPCPATSPPSPA

SEQ ID NO: 199 - protein, 25 aa, Artificial Sequence
  Linker sequence
DKTHTCPPCPATSPPSPATCPPSPA

SEQ ID NO: 200 - protein, 25 aa, Artificial Sequence
  Linker sequence
DKTHTCPPSPATCPPSPATCPPSPA

SEQ ID NO: 201 - protein, 25 aa, Artificial Sequence
  Linker sequence
DKTHTSPPCPATCPPSPATCPPSPA

SEQ ID NO: 202 - protein, 25 aa, Artificial Sequence
  Linker sequence
DKTHTCPPSPATSPPCPATCPPSPA

SEQ ID NO: 203 - protein, 25 aa, Artificial Sequence
  Linker sequence
DKTHTSPPCPATSPPCPATCPPSPA

SEQ ID NO: 204 - protein, 25 aa, Artificial Sequence
  Linker sequence
DKTHTSPPSPATSPPCPATCPPCPA

SEQ ID NO: 205 - protein, 25 aa, Artificial Sequence
  Linker sequence
DKTHTSPPSPATCPPSPATCPPCPA

SEQ ID NO: 206 - protein, 25 aa, Artificial Sequence
  Linker sequence
DKTHTSPPSPATCPPCPATSPPCPA

SEQ ID NO: 207 - protein, 25 aa, Artificial Sequence
  Linker sequence
DKTHTSPPSPATCPPCPATCPPSPA

SEQ ID NO: 208 - protein, 25 aa, Artificial Sequence
  Linker sequence
DKTHTCPPSPATSPPSPATCPPCPA

SEQ ID NO: 209 - protein, 25 aa, Artificial Sequence
  Linker sequence
DKTHTCPPSPATSPPCPATSPPCPA

SEQ ID NO: 210 - protein, 25 aa, Artificial Sequence
  Linker sequence
DKTHTCPPSPATCPPSPATSPPSPA

SEQ ID NO: 211 - protein, 25 aa, Artificial Sequence
  Linker sequence
DKTHTCPPSPATSPPSPATCPPSPA

SEQ ID NO: 212 - protein, 25 aa, Artificial Sequence
  Linker sequence
DKTHTSPPSPATSPPCPATCPPSPA

SEQ ID NO: 213 - protein, 25 aa, Artificial Sequence
  Linker sequence
DKTHTSPPSPATSPPSPATCPPCPA

SEQ ID NO: 214 - protein, 25 aa, Artificial Sequence
  Linker sequence
DKTHTSPPSPATSPPCPATSPPCPA

SEQ ID NO: 215 - protein, 25 aa, Artificial Sequence
  Linker sequence
DKTHTSPPSPATSPPCPATCPPSPA

SEQ ID NO: 216 - protein, 25 aa, Artificial Sequence
  Linker sequence
DKTHTCPPSPATSPPSPATSPPCPA

SEQ ID NO: 217 - protein, 25 aa, Artificial Sequence
  Linker sequence
DKTHTCPPSPATSPPSPATSPPSPA

SEQ ID NO: 218 - protein, 25 aa, Artificial Sequence
  Linker sequence
DKTHTSPPSPATSPPSPATSPPCPA

SEQ ID NO: 219 - protein, 25 aa, Artificial Sequence
  Linker sequence
DKTHTSPPCPATSPPSPATSPPSPA

SEQ ID NO: 220 - protein, 25 aa, Artificial Sequence
  Linker sequence
DKTHTSPPSPATCPPSPATSPPSPA

SEQ ID NO: 221 - protein, 25 aa, Artificial Sequence
  Linker sequence
DKTHTSPPSPATSPPCPATSPPSPA

SEQ ID NO: 222 - protein, 25 aa, Artificial Sequence
  Linker sequence
DKTHTSPPSPATSPPSPATCPPSPA

SEQ ID NO: 223 - protein, 25 aa, Artificial Sequence
  Linker sequence
DKTHTSPPSPATSPPSPATSPPSPA

SEQ ID NO: 224 - protein, 30 aa, Artificial Sequence
  Linker sequence
DKTHTCPPCPAGKPTLYNSLVMSDTAGTSY

SEQ ID NO: 225 - protein, 30 aa, Artificial Sequence
  Linker sequence
DKTHTCPPSPAGKPTLYNSLVMSDTAGTCY

SEQ ID NO: 226 - protein, 30 aa, Artificial Sequence
  Linker sequence
DKTHTSPPCPAGKPTLYNSLVMSDTAGTCY

SEQ ID NO: 227 - protein, 30 aa, Artificial Sequence
  Linker sequence
DKTHTCPPSPAGKPTLYNSLVMSDTAGTSY

SEQ ID NO: 228 - protein, 30 aa, Artificial Sequence
  Linker sequence
DKTHTSPPSPAGKPTLYNSLVMSDTAGTCY

SEQ ID NO: 229 - protein, 30 aa, Artificial Sequence
  Linker sequence
DKTHTSPPCPAGKPTLYNSLVMSDTAGTSY

SEQ ID NO: 230 - protein, 30 aa, Artificial Sequence
  Linker sequence
DKTHTSPPSPAGKPTLYNSLVMSDTAGTSY

SEQ ID NO: 231 - protein, 31 aa, Artificial Sequence
  Linker sequence
DKTHTCPPCPAGKPTHVNVSVVMAEVDGTSY

SEQ ID NO: 232 - protein, 31 aa, Artificial Sequence
  Linker sequence
DKTHTCPPSPAGKPTHVNVSVVMAEVDGTCY

SEQ ID NO: 233 - protein, 31 aa, Artificial Sequence
  Linker sequence
DKTHTSPPCPAGKPTHVNVSVVMAEVDGTCY

SEQ ID NO: 234 - protein, 31 aa, Artificial Sequence
  Linker sequence
DKTHTCPPSPAGKPTHVNVSVVMAEVDGTSY

SEQ ID NO: 235 - protein, 31 aa, Artificial Sequence
  Linker sequence
DKTHTSPPCPAGKPTHVNVSVVMAEVDGTSY

SEQ ID NO: 236 - protein, 31 aa, Artificial Sequence
  Linker sequence
DKTHTSPPSPAGKPTHVNVSVVMAEVDGTCY

SEQ ID NO: 237 - protein, 31 aa, Artificial Sequence
  Linker sequence
DKTHTSPPSPAGKPTHVNVSVVMAEVDGTSY

SEQ ID NO: 238 - protein, 15 aa, Artificial Sequence
  Linker sequence
DKTHTCCVECPPSPA

SEQ ID NO: 239 - protein, 15 aa, Artificial Sequence
  Linker sequence
DKTHTCCVESPPCPA

SEQ ID NO: 240 - protein, 15 aa, Artificial Sequence
  Linker sequence
DKTHTCSVECPPCPA

SEQ ID NO: 241 - protein, 15 aa, Artificial Sequence
  Linker sequence
DKTHTSCVECPPCPA

SEQ ID NO: 242 - protein, 15 aa, Artificial Sequence
  Linker sequence
DKTHTCCVESPPSPA

SEQ ID NO: 243 - protein, 15 aa, Artificial Sequence
  Linker sequence
DKTHTCSVECPPSPA

SEQ ID NO: 244 - protein, 15 aa, Artificial Sequence
  Linker sequence
DKTHTSCVECPPSPA

SEQ ID NO: 245 - protein, 15 aa, Artificial Sequence
  Linker sequence
DKTHTCSVESPPCPA

SEQ ID NO: 246 - protein, 15 aa, Artificial Sequence
  Linker sequence
DKTHTSSVECPPCPA

SEQ ID NO: 247 - protein, 15 aa, Artificial Sequence
  Linker sequence
DKTHTCSVESPPSPA

SEQ ID NO: 248 - protein, 15 aa, Artificial Sequence
  Linker sequence
DKTHTSSVECPPSPA

SEQ ID NO: 249 - protein, 15 aa, Artificial Sequence
  Linker sequence
DKTHTSSVESPPCPA

SEQ ID NO: 250 - protein, 15 aa, Artificial Sequence
  Linker sequence
DKTHTSSVESPPSPA

SEQ ID NO: 251 - protein, 26 aa, Artificial Sequence
  Linker sequence
DKTHTCPRCPEPKSCDTPPPCPRSPA

SEQ ID NO: 252 - protein, 26 aa, Artificial Sequence
  Linker sequence
DKTHTCPRCPEPKSCDTPPPSPRCPA

SEQ ID NO: 253 - protein, 26 aa, Artificial Sequence
  Linker sequence
DKTHTCPRCPEPKSSDTPPPCPRCPA

SEQ ID NO: 254 - protein, 26 aa, Artificial Sequence
  Linker sequence
DKTHTCPRSPEPKSCDTPPPCPRCPA

SEQ ID NO: 255 - protein, 26 aa, Artificial Sequence
  Linker sequence
DKTHTSPRCPEPKSCDTPPPCPRCPA

SEQ ID NO: 256 - protein, 26 aa, Artificial Sequence
  Linker sequence
DKTHTCPRCPEPKSCDTPPPSPRSPA

SEQ ID NO: 257 - protein, 26 aa, Artificial Sequence
  Linker sequence
DKTHTCPRCPEPKSSDTPPPCPRSPA

SEQ ID NO: 258 - protein, 26 aa, Artificial Sequence
  Linker sequence
DKTHTCPRSPEPKSCDTPPPCPRSPA

SEQ ID NO: 259 - protein, 26 aa, Artificial Sequence
  Linker sequence
DKTHTSPRCPEPKSCDTPPPCPRSPA

SEQ ID NO: 260 - protein, 26 aa, Artificial Sequence
  Linker sequence
DKTHTCPRCPEPKSSDTPPPSPRSPA

SEQ ID NO: 261 - protein, 26 aa, Artificial Sequence
  Linker sequence
DKTHTCPRSPEPKSCDTPPPSPRSPA

SEQ ID NO: 262 - protein, 26 aa, Artificial Sequence
  Linker sequence
DKTHTSPRCPEPKSCDTPPPSPRSPA

SEQ ID NO: 263 - protein, 26 aa, Artificial Sequence
  Linker sequence
DKTHTCPRSPEPKSSDTPPPCPRSPA

SEQ ID NO: 264 - protein, 26 aa, Artificial Sequence
  Linker sequence
DKTHTSPRCPEPKSSDTPPPCPRSPA

SEQ ID NO: 265 - protein, 26 aa, Artificial Sequence
  Linker sequence
DKTHTSPRSPEPKSCDTPPPCPRSPA

SEQ ID NO: 266 - protein, 26 aa, Artificial Sequence
  Linker sequence
DKTHTCPRSPEPKSSDTPPPSPRCPA

SEQ ID NO: 267 - protein, 26 aa, Artificial Sequence
  Linker sequence
DKTHTSPRCPEPKSSDTPPPSPRCPA

SEQ ID NO: 268 - protein, 26 aa, Artificial Sequence
  Linker sequence
DKTHTSPRSPEPKSSDTPPPCPRCPA

SEQ ID NO: 269 - protein, 26 aa, Artificial Sequence
  Linker sequence
DKTHTCPRSPEPKSSDTPPPSPRSPA

SEQ ID NO: 270 - protein, 26 aa, Artificial Sequence
  Linker sequence
DKTHTSPRSPEPKSSDTPPPCPRSPA

SEQ ID NO: 271 - protein, 26 aa, Artificial Sequence
  Linker sequence
DKTHTSPRSPEPKSCDTPPPSPRSPA

SEQ ID NO: 272 - protein, 26 aa, Artificial Sequence
  Linker sequence
DKTHTSPRCPEPKSSDTPPPSPRSPA

SEQ ID NO: 273 - protein, 26 aa, Artificial Sequence
  Linker sequence
DKTHTSPRSPEPKSSDTPPPSPRSPA

SEQ ID NO: 274 - protein, 11 aa, Artificial Sequence
  Linker sequence
DKTHTCPSSPA

SEQ ID NO: 275 - protein, 11 aa, Artificial Sequence
  Linker sequence
DKTHTSPSCPA

SEQ ID NO: 276 - protein, 11 aa, Artificial Sequence
  Linker sequence
DKTHTSPSSPA

SEQ ID NO: 277 - protein, 4 aa, Artificial Sequence
  Linker sequence
GGGS

SEQ ID NO: 278 - DNA, 35759 bp, Artificial Sequence
  NG-616 genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctttctctcttcaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggacagtgtactaattatgctctcttgaaattggctggagatgttgagagcaaccctggacctacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccgggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 279 - DNA, 18 bp, Artificial Sequence
  Primer
tacatgcacatcgccgga

SEQ ID NO: 280 - protein, 16 aa, Artificial Sequence
  Primer
CGGGCGAACTGCACCA

SEQ ID NO: 281 - protein, 27 aa, Artificial Sequence
  Probe
CCGGACTCAGGTACTCCGAAGCATCCT

The invention claimed is:

1. An adenovirus comprising a sequence of formula (I):

$$5'TTR\text{-}B_1\text{-}B_4\text{-}B_2\text{-}B_X\text{-}B_B\text{-}B_Y\text{-}B_3\text{-}3'TTR \quad (I)$$

wherein:
$B_1$ is a bond or comprises: E1A, E1B or E1A-E1B;
$B_4$ comprises: E2B-L1-L2-L3-E2A-L4;
$B_2$ is a bond or comprises: E3;
$B_X$ is a bond or a DNA sequence comprising: a restriction site, one or more transgenes or both;
$B_B$ comprises: L5;
$B_Y$ comprises: a transgene cassette comprising four transgenes, said transgenes encoding a FAP-bispecific T cell activator, CXCL10, CXCL9, and IFNα as shown in SEQ ID NO: 95 or a polynucleotide encoding the same amino acid sequence; and
$B_3$ is a bond or comprises: E4.

2. An adenovirus according to claim 1, wherein the transgene cassette has a polynucleotide sequence shown in SEQ ID NO: 95.

3. An adenovirus according to claim 1, wherein the adenovirus comprises SEQ ID NO: 84.

4. An adenovirus according to claim 1, wherein the adenovirus is replication competent.

5. An adenovirus according to claim 1, wherein the adenovirus is oncolytic.

6. An adenovirus according to claim 1, wherein the virus has a hexon and fibre from Ad11.

7. A pharmaceutical composition comprising an adenovirus according to claim 1 and an excipient, diluent or carrier.

8. A method of treating a patient having a cancer of epithelial origin, comprising administering an adenovirus according to claim 1, or a pharmaceutical composition according to claim 7.

9. A method according to claim 8, wherein the cancer is lung, breast, bladder, renal, or colorectal cancer.

* * * * *